United States Patent 7,745,391 (HUMAN THROMBOSPONDIN POLYPEPTIDE) - sequence listing, part 80

SEQ ID NO: 282349 - DNA, 6654 bp, Homo sapiens
  misc_feature (4646)..(4646): n is a, c, g, or t
  misc_feature (4659)..(4659): n is a, c, g, or t
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaattttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagnctgtctcctgacngccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 282350 - DNA, 6659 bp, Homo sapiens
  misc_feature (4651)..(4651): n is a, c, g, or t
  misc_feature (4664)..(4664): n is a, c, g, or t
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaacacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagnctgtctcctgacngccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 282351 - DNA, 4657 bp, Homo sapiens
  misc_feature (2649)..(2649): n is a, c, g, or t
  misc_feature (2662)..(2662): n is a, c, g, or t
attcctcttttactctcacccccaggctctggagtgaccaacctcgcataaccaaagatgtgatttgttttcatgctgaggattttactgatgttgtacaaagacttcagttagatcttcatgaacctccagtttcccagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagnctgtctcctgacngccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 282352 - DNA, 454 bp, Homo sapiens
tcatgctgatcatgtcggtcaggggtttgactggcagagtacggctgctgttggagttttgaaagctgtacaatttggtgaatggtgagttaattgaactcaactgcaaggttggttaatattgtataagacaatgtggactctatttaaaaggtttaggaccagttttttaaattgtggtaaaatacacataaagtttgccatcttaaccatttttaaatgtacatttggtagagttaagcatctttacattgttacgaaacagagctccagaaccttttcatcttgcgaggctgtaactctatactcactgaacaacaattcctcttttactctcacccccaggctctggtaaccatcattctactttgtttctatgaatttgactactttacatatttcatatagatggaatcatatagtgtttatctttttgtgactggcttatttctct

SEQ ID NO: 282353 - DNA, 524 bp, Homo sapiens
ttgttgatttacctgtatgtatcatagtaattcataggctgacagcaaaatatgcctagcttaaatttaaattttatgatgataactgaacaaaagaatctatgttgttacatagatttcagaatcatcatatttagctatcgtataatgtttcataccattgctatatcatgatttatttaaccattctctgttttttggatgtgtgaattatttctgatttttctccattatcagtaatatactgctttgaaaaatggataccttcaattttattcttttcttcaatccagaatattattatatttaagatctctgtctcatttgttttctaaacacgtaagttgtaatagcaaattcagagaaattgaggataggctatttaatgagatcaagtaccttaagaagcttgtatgttgacactagtcctagcaactaacttctttttaattattgtggccagaaacaccagatgaaaatggtaaaacccagagagccgatgattttgtcttgaagaaaataaa

SEQ ID NO: 282354 - DNA, 6085 bp, Homo sapiens
  misc_feature (4704)..(4704): n is a, c, g, or t
  misc_feature (4717)..(4717): n is a, c, g, or t
  misc_feature (6023)..(6023): n is a, c, g, or t
  misc_feature (6033)..(6033): n is a, c, g, or t
  misc_feature (6045)..(6046): n is a, c, g, or t
  misc_feature (6051)..(6051): n is a, c, g, or t
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagnctgtctcctgacngccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaatcaaacangtcgaactgnatttatttgccnnccagntgaggaaatgcacccttctggttttttttaacct

SEQ ID NO: 282355 - DNA, 1672 bp, Homo sapiens
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaaaagggacatacttggtggggcacctaccggaccgggccttatgcggaaaaaaaatttttttgggacctttatatgaaaaaattgggggattttttcccaaaaattctttgattttgttagaaaaaacccccttt

SEQ ID NO: 282356 - DNA, 818 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaagggtgttctccaggcaccaacggaagggggaatggggtgatccagccgaattcttgaattcgggttacc

SEQ ID NO: 282357 - DNA, 408 bp, Homo sapiens
taaactcaagcaaatgagtgacaacattcagccaaactagttgtgagattctgctatatcaaataattagtgagatgaccagatgcttatcttttcagctgacggcattattaccaggagcatacaaccagtcagctcaggctgctaacatttttgccagaaggatcaatgagtagctggtactagacgtgaaaggagagccatagtaaagcatctttatccataagtcaacagctagacctaaacttaagttgcatttgaggtttttattttaatcctacaggtgtaaataagttaccaccaccaagtgtcatgatagaggaaattaatgcaaggaaagaaaacaagcccagttggtaagttaactacttaatgcaccctttttaaattataactgaaattggtaaa

SEQ ID NO: 282358 - DNA, 2507 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282359 - DNA, 2312 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282360 - DNA, 1390 bp, Homo sapiens
cttttgaagggactcatcttgatttaagaaacagaaggagaccgttagataggtagggaaataaaggggaaaatgcagaaaccatcccaaattctgcagcagtatttgtttgctttgggcacttgtacttgttctaagattatcagtttttttgtcttcaccttttcccccaatcttccttttataaaggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282361 - DNA, 2135 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaaccta

SEQ ID NO: 282362 - DNA, 1564 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtaagtataagaaatagcagggcatgtgtttttggtgtgccatgtgattctggatactggaaatgttgagactattattcctcctgcttctatttaaaataacagaatctttaaaagcaggatgcattctattgtttgctgaattatactgtcataatgatttgttccattactgcataaatggtatatcagggtcaaaaatatatatatttttttgatataccaaaaatataacagttgacataggctgtatctatg

SEQ ID NO: 282363 - DNA, 1124 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282364 - DNA, 2580 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282365 - DNA, 2588 bp, Homo sapiens
cgctacagaagattcaaactgagcaaatcgcctaatcttccaaattctttttcctggcttgttagagcagccaagggtggggtggagcttgtgaataaaaagcctgcttcatcttcctcatgcaggagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282366 - DNA, 1895 bp, Homo sapiens
gtgaggcttccccagccacaaggaactaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282367 - DNA, 1557 bp, Homo sapiens
taaactcaagcaaatgagtgacaacattcagccaaactagttgtgagattctgctatatcaaataattagtgagatgaccagatgcttatcttttcagctgacggcattattaccaggagcatacaaccagtcagctcaggctgctaacatttttgccagaaggatcaatgagtagctggtactagacgtgaaaggagagccatagtaaagcatctttatccataagtcaacagctagacctaaacttaagttgcatttgaggtttttattttaatcctacaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282368 - DNA, 2482 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaaaaaaaaatttgttctcttattaaagattgggaaaagggagaaaaagatgaggattctatgaataaagctcataaaaggatagggggttcaatgagttactttgagagtttcccaaaggactgtacctgcctgggactgttcattcctccagaacactctttataacaaagctgttactccagctggcctcccaaagacccaaatcagattccacagaaaaccaccacctccacgggctcttagaaccagcctccagcagccaaaggaaaaagcctacctgcttagatcctccttcacaaccctgctgtaagaggcaaatggagctgcctccttttaaagagtcaatgagaaccaaccaaattcaattggaattcattagataaagagcacagccaagaagcttttaatggagagaaagcagggagagg

SEQ ID NO: 282369 - DNA, 637 bp, Homo sapiens
caggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagcagacatggtcttccacctctctgagcctttcttagaaaactctgagaagttgactgaagcatctgggtgctgcttcttatgctcttcccgacaagtttgcacaaaaaatgcatatgatgacattttgcctcttggcttcttagaatctcctttgccaatgtttagttatttttccccagtgaggcacagagt

SEQ ID NO: 282370 - DNA, 1315 bp, Homo sapiens
gactgggcgcagcggagacctcggcatctgcggtgctcgggattgtgtcccctacggtctcttaccgtgcctcccgatggcgggagctggaatttggtccccagaccccttgggaagacgcgcacaccctggcaaaccatgtgtacacccgcggtagaagcaggtcttcaagaccaaggaacacctacactccaggtgtctccttgccagatgtttcacctgcattggtaaaaggcagaatcctcggcaggggtcggtggctcacgcttgtaatcccagcactttgagacgccgaggcgggtggatcacgaggtcaggaattcaagaccagcctggccaagatggtggaaccccgtctctactaacagcacaaaaattagctgggcctggtggcgcatgcctgtaatcccagctaatgggaaggctgaggcagagaatggcttgaacccaggaggcagaggttgcagtgagccgagatcacgccactgcactccagcctgggcgacagagcatgactccatctcaaaaaaaagaaaagaatcctgggatgagctccgcccccccaccagccgagggacaggcctgagggaaacgctgaccagtttgtgtgaacgccatcacccacactcttgaaatatatctggaaagtgccggaagtgaactgggggatccttgcctccccaaaacagggatgggctctgaacgccccaccacggcctgctgccacgcgcgcctctcgctgcaggagcggtggatccaccgatgggcttccagggcggtcttgcgcttgaagcctttcccacactccacgcaggggaagggccggctgtcggagtgaatgcgccggtgactgaggaggagggaagaataggtgaagcggcggccgcagtcaggacaggggtagggcttctcgccggtgtgtatgcgcctgtggatggccagcagggaggtgtaggcgaaacggaggctgcaatcggggcagctgtagggcttctcgcccgtgtgcttgcgctggtggatggccagcaggtaggggtaagtgaagcgactcttgcagtctgagcacgcgtaaggcttctccccggtgtgagcccgcctgtggatagccagggaacccctctggcggaagcggcgcccgcagtcggggcaggggtagggcttctcgccggtgtggatgaactgatgctggagcaggtacctgcgctgggagaaacgcgcctgacactggccgcaggagaagggccgctccccggagtggacccgctggtggctggccaggagggaagggtagctgaagttgcggccacagtctggg

SEQ ID NO: 282371 - DNA, 891 bp, Homo sapiens
gactgggcgcagcggagacctcggcatctgcggtgctcgggattgtgtcccctacggtctcttaccgtgcctcccgatggcgggagctggaatttggtccccagaccccttgggaagacgcgcacaccctggcaaaccatgtgtacacccgcggtagaagcagggaaacgctgaccagtttgtgtgaacgccatcacccacactcttgaaatatatctggaaagtgccggaagtgaactgggggatccttgcctccccaaaacagggatgggctctgaacgccccaccacggcctgctgccacgcgcgcctctcgctgcaggagcggtggatccaccgatgggcttccagggcggtcttgcgcttgaagcctttcccacactccacgcaggggaagggccggctgtcggagtgaatgcgccggtgactgaggaggagggaagaataggtgaagcggcggccgcagtcaggacaggggtagggcttctcgccggtgtgtatgcgcctgtggatggccagcagggaggtgtaggcgaaacggaggctgcaatcggggcagctgtagggcttctcgcccgtgtgcttgcgctggtggatggccagcaggtaggggtaagtgaagcgactcttgcagtctgagcacgcgtaaggcttctccccggtgtgagcccgcctgtggatagccagggaacccctctggcggaagcggcgcccgcagtcggggcaggggtagggcttctcgccggtgtggatgaactgatgctggagcaggtacctgcgctgggagaaacgcgcctgacactggccgcaggagaagggccgctccccggagtggacccgctggtggctggccaggagggaagggtagctgaagttgcggccacagtctggg

SEQ ID NO: 282372 - DNA, 549 bp, Homo sapiens
aatcatgaaggaaaagccagttaggtgaatggttttcagtgaaggatgggacgtgaacacggggccctgtgtgctggagcttcagaaaatggggtcaacccccaggcaccttttcagattcctgcctcctccccacagccctctgtgcccctacctctgctttttacctaaggcagaactttgttttcctcaaacgcccacttcctttccttatcccccaaatacacaaaccttgcctcttcctctccagggaaacgctgaccagtttgtgtgaacgccatcacccacactcttgaaatatatctggaaagtgccggaagtgaactgggggatccttgcctccccaaaacagggatgggctctgaacgccccaccacggcctgctgccacgcgcgcctctcgctgcaggagcggtggatccaccgatgggcttccagggcggtcttgcgcttgaagcctttcccacactccacgcaggggaagggccggctgtcggagtgaatgcgccggtgactgaggaggagggaagaataggtgaagcggcggccg

SEQ ID NO: 282373 - DNA, 980 bp, Homo sapiens
  misc_feature (905)..(905): n is a, c, g, or t
gtgggggaggggagcgaatcttaggctaggtacgaggctgggtgtgcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatgggggntgggggagtaagacggccaagaggagatgggtgtaagccttttggccacatgttaggatggcgcctccgaaattg

SEQ ID NO: 282374 - DNA, 925 bp, Homo sapiens
acttaaaacagttgaatcaaaggcaataccctgctacttgttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282375 - DNA, 2941 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282376 - DNA, 2837 bp, Homo sapiens
gtgggggaggggagcgaatcttaggctaggtacgaggctgggtgtgcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282377 - DNA, 2802 bp, Homo sapiens
gtgggggaggggagcgaatcttaggctaggtacgaggctgggtgtgagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282378 - DNA, 2830 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282379 - DNA, 2904 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282380 - DNA, 2820 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282381 - DNA, 2975 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagaccacttaatcgtgtgggctttctccaaatttcagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282382 - DNA, 2447 bp, Homo sapiens
cccggagctcccgggaaaattatcccaggagaaattattatcgtacagaatcccaaacggacggcttccggagacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282383 - DNA, 2914 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282384 - DNA, 1618 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaaaaacatcaccaaaaatgcccatgggcctccgaacttctggttatttatggggacacactgctaagattttttagctggaccccacgagcctgggtatttgctagggctggggaacaacatcaatatggcgagggcggtatttcatgtggagggcgtgtg

SEQ ID NO: 282385 - DNA, 1535 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagttatgggatctggtacgttaaattatatgcatacttcgatttataagatgaatttagtcactggtttcaatatgaatatctggtaagtggtagaccgcgccgattgggattagtaaatgggggaaaagaaaatgaaatggccgaaacgttttgagaccagtatatttgaccaagtggtagggcggaaatgaagaggataagacaggtacaggatacaagttgtgataacaaaaaatc

SEQ ID NO: 282386 - DNA, 1807 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatgtaaggtggaaaattcagtgggatcttgttaaatgggtgacctgaatgaccatcagtgattgctgcaggctgtagtttgatttttttttttttaagttatggctttaaaaaacagctttaggtagcttactcctgtaatctcaataccttgggaagctgaggcaggaggattgcttgagaccaggagtgtgagactctacacaaaatttaaaaacaaaaaattagttgggtatggtggtgtgcacctgtagtcctagctactcaggaggctgaagtgggaggatcacttattatttagaaaaaaagaaaactaggtatggacatgtgaaggaacatacttggtgtggtggtaaatatcaaaattgagatccagagtgatgccagttggaggtcgaggaggaaaatgatttcatcaaggtgtggccacagggcttcattcacttataatcttataaagaaatacctgaggcaaatgtgacaaaatactgggcatttgtcaaaactagttttaggtatcagattgtgacattattctctacatagtctgtattttgtgtacacttgaaatagttggtaattaaaataggaatctaatttaaaatggtcgaggtctgaatcaccagctgtgtggttggtttcttca

SEQ ID NO: 282387 - DNA, 1084 bp, Homo sapiens
  misc_feature (1009)..(1009): n is a, c, g, or t
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatgggggntgggggagtaagacggccaagaggagatgggtgtaagccttttggccacatgttaggatggcgcctccgaaattg

SEQ ID NO: 282388 - DNA, 930 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagccagaagtaaggtttggcttttccggaatcacaattgagggcg

SEQ ID NO: 282389 - DNA, 1148 bp, Homo sapiens
cagcatggttccactggagttctcctgcatcatgccttctgaataaatgccgatttatccaatggaaaaaaaaaaaagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282390 - DNA, 309 bp, Homo sapiens
ttgttctctgtaggtttcgaatgtatcatttagtggtcgaggtctgaatcaccagctgtgtggttggtttcttcatgaaggggagcacatagtggagctagttgtggagtgcagtgacagtgatgtgaggccgaatgtgagtgtgtcatccctgggtgccgtgtgcctttacctttgtgttttagatgggacaccaggtccaataccacctccaagccgagtcacttggtggatgcgcacactgccgaagtcaactgcctctcattcaatccctacagcgaatttattctagccaccggctctgcggat

SEQ ID NO: 282391 - DNA, 577 bp, Homo sapiens
gattgaaataagtagtgcatcgatgggtggctaagtatacatacggaattacacactggcaaagaatttttcaaaatactggctagcctaccatttccttattgaagtttttaagagagaaatgtaaaaatgaaactattaagttctaaatagattaaattgtttttacatgaccatgtgaaaaccatagggagtttttacctgtgaatttatttggttatctccaggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttct

SEQ ID NO: 282392 - DNA, 307 bp, Homo sapiens
caagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcaga

SEQ ID NO: 282393 - DNA, 281 bp, Homo sapiens
cttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaa

SEQ ID NO: 282394 - DNA, 2860 bp, Homo sapiens
gcctcgtgccgaatcggcacgaggcagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282395 - DNA, 2998 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataaggtatgtgacagttttctggtgtctgtatgtcaggaaatgaaatccagggattcatcagttaagctataccagactcgtgggtccactattgaaaaaaatgtcttgtacgtggtgttacatggagatgctcatagggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282396 - DNA, 2888 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282397 - DNA, 2892 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccaacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282398 - DNA, 3010 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggtgggcagtgtgtaccgctgctgtggtgcagatacggccaggcagtccgcccaatgcgcgtctggagcgtgcatcattgtgcttataacgacgtaagcgacgttccgcatgcgctgcgcaggctggatggtggccgcagaacctgaaccctggacgtcgatagggattgggccggagttacacaatggagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282399 - DNA, 1801 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaaattcttgggaggacagcgatcttcagccccacaagacattaagaactgacactccaccacaacctccaagaacacatcagtttcagaactcaaggcagcatgattcaggt

SEQ ID NO: 282400 - DNA, 2877 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282401 - DNA, 2865 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggaaaaattgaatgtgaaattaaaatcaatcacgaaggagaagtaaaccgtgctcgttacatgccgcagaatcctcacatcattgctacaaaaacaccaacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282402 - DNA, 2450 bp, Homo sapiens
tgaggaccctgcgagctgcaggaattcgtcacgacgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaacctttctgggccagcctagtagcattacagtgttctagaatatggtagatacggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagttggcggcca

SEQ ID NO: 282403 - DNA, 933 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagccagacccaagtggagaatggatcccggacttagattgagtcacct

SEQ ID NO: 282404 - DNA, 889 bp, Homo sapiens
tatcgtcgacccacggcgctcggaaaccgcccgccgcgcgtcattggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggtaggtatatcatatattccaatattggtgtcaaagggaaaatgtctctttcaaagcatatgctattaaaactatactattagcttttggcccagtaatttaacttctaggactttattctacagaacttcccacccacacgtgcaccaaggatttcgtcgtaattgcagaattga

SEQ ID NO: 282405 - DNA, 391 bp, Homo sapiens
aagatttggcccgcaatcagtctgattggttgaggtactttcaatttccatctgcctgtcagaaaagagggagagttcgatgccaggacagtccagatccaacggctacagaacccatgaggatgggctataaaatatgtgaagaattaaagaagcacagtgaaatacacattattgatacgcagctgaaacatgggatacaatccatctatgaataactggtacagtccagactccatttttgcagtctacaccaaccaaacaagcaaaattaatgtatttaaataaagaagaaaatataaaagcaacagaataaaaagcttcttatatgaatactggccaaaaaaacctgttgtcactggtaatgtaaacatcaaaaaaaaaccacaca

SEQ ID NO: 282406 - DNA, 405 bp, Homo sapiens
ttgtgaatctaaggtacagaaaacactttatacttcagtcacccaaaacaacagcttgtggtctcctccaattacacacagagggagagttcgatgccaggacagtccagatccaacggctacagaacccatgaggatgggctataaaatatgtgaagaattaaagaagcacagtgaaatacacattattgatacgcagctgaaacatgggatacaatccatctatgaataactggtacagtccagactccatttttgcagtctacaccaaccaaacaagcaaaattaatgtatttaaataaagaagaaaatataaaagcaacagaataaaaagcttcttatatgaatactggccaaaaaaacctgttgtcactggtaatgtaaacatcaaaaaaaaaccacaca

SEQ ID NO: 282407 - DNA, 459 bp, Homo sapiens
gcttagcttgggctcagaggcctgacaatcacctgatgggttcttcttgctcactgcacagacaaaaccaattcactgagatcatactattgcagtagagaaagagttcaattaacagtcctagcaggagcatggatgttattactcaaatcagtctctccaagaactcagaggctagggttttaatggataatttgattctggccccaagcctgtttcctgctgaggcccagcccaccacagtggaattcatccagcagctgggacggttggcaccatctgctccagaaagctgggatgatgaaaatgtgtggctgcagaactgaacagtggccaaacttgtggggtagtaaagccaaggcaacgtatatagctacctgcactttggaactgtgctgacttataattatagaatgtttacaacttgaagggacaataaaaacccttgactggtttatt

SEQ ID NO: 282408 - DNA, 510 bp, Homo sapiens
gcaaacctgtgccagcctgcaatgtgaagccctaaagctttggcatctctgctgggctctgagccaggtgcctggcagggccccaagaactactttcagcaaatcttcaggcaacgccgaaggtggtgagaagcaggaggcagagcgagaaggcaggaatggaggggccccctagaggcaccagcttaagaggaaggttcacgagctcaggaggacttgggggagtgctgcaagatggtgcgagaaatggagaaggaagacagaacggggaagaatggctcctccgttgacggagatgcggaatggctccagagtcagagggcttcctgagtcttccggagtctaactgaagatccggttgcagcagaagcccatttctttcagccttgcccaccatgcctgccacccgacctccacctgtcccccgagtggggggctccctggctgtaagacagctcccaccagccattttcttctccagagaaagcattttcagttctttcaatcttt

SEQ ID NO: 282409 - DNA, 1074 bp, Homo sapiens
tcaaaacccagacagaaacgtccaacaaactcccagtccaggagcgctgcaaaaccaacgccagtctagtttggggtctctataatcctgctcctttggctgccagccatctccataaaaaaagaatttgaaaggcttccattctttcagagacctgtttcccgggactggctgcaagggagagatgcactgaccttctgccaggtatagaactattgaatggtacagtttgagatcttcgaaaccatcaggactgatcattttctggctactttctacataggaatcctagagttccttggagaggatatgaaggttattctcaggccatgcagatgggcaagaaaggatgtgcgtccatggttcctcttcaaatccaaccaaaacagccttgcttccgttggctttatataatactgcaactcttgataatctgatttaacacaaatttcctcattgagtttctcctcatgaagaaacggcctcagtgaggtaaatcggaatgcacaggagcacatagcaggttagtgcagaccagaaatcaaacccaggctttctgactgctcaatagaccacaatctaccatgctaccatggaaactttaaaacagatgaaagtaaaaacaaacaaacaacaacttaaaaaaacaaaaacaaaaacaaaagcaaaacccagagcctctctaggaaataccaacgtgcttttgccaagtggggtttctctcacttcataagagcagtaaacactaaaccaagggaatgtgaatttagaggttagaaaagataaccagagatttggccgtgcgtggggctcatgcctgtaatcccagcactttgggaggctgaggctggtgggtgcctgaggtcaggagtttgagaccagctggccaacatagtgaaaccctgtctctactaaaaatacaaaattagctgggtgtggtggcgtgcacctgtaatcccagctactagggaggctgaggcaggagaatcgcttgaactggagaggtggaggttgcagtgagccgagatggtgccattgcactccagcccgggcaagaagattgaaattccatct

SEQ ID NO: 282410 - DNA, 1320 bp, Homo sapiens
aacagtttgttagatgaatgaaaggattgggaggaagaatgaaaagatacctttcctttagacatttctaagcttgcaaatgcacaggcaatgagaaccacctctcttcactccctggcatttgaggctttttacgtaaaaatttaaactaatgattatattagaaatttttaaatgtttaaaaaaagtatgttgtaaaattgaggaaatatagtattttgagagtccaaacacgttcatgcagttgattgagcctaagtgttgggttaatcctagtaagtgattgatctttttaggtaggtaagggaataaacagaagatcagaaaagaagaggtactactattacattttaagtttccaaatatactactaagtgtctctagtaaaacttaactcattgaagaagaaaatagtctgactctaaaaaaagagtgtgtgttcctgagaaagactaaaccagttattttctcctttcatgtttgaatgaataaccatcagcaagggagagatgcactgaccttctgccaggaatcctagagttccttggagaggatatgaaggttattctcaggccatgcagatgggcaagaaaggatgtgcgtccatggttcctcttcaaatccaaccaaaacagccttgcttccgttggctttatataatactgcaactcttgataatctgatttaacacaaatttcctcattgagtttctcctcatgaagaaacggcctcagtgaggtaaatcggaatgcacaggagcacatagcaggttagtgcagaccagaaatcaaacccaggctttctgactgctcaatagaccacaatctaccatgctaccatggaaactttaaaacagatgaaagtaaaaacaaacaaacaacaacttaaaaaaacaaaaacaaaaacaaaagcaaaacccagagcctctctaggaaataccaacgtgcttttgccaagtggggtttctctcacttcataagagcagtaaacactaaaccaagggaatgtgaatttagaggttagaaaagataaccagagatttggccgtgcgtggggctcatgcctgtaatcccagcactttgggaggctgaggctggtgggtgcctgaggtcaggagtttgagaccagctggccaacatagtgaaaccctgtctctactaaaaatacaaaattagctgggtgtggtggcgtgcacctgtaatcccagctactagggaggctgaggcaggagaatcgcttgaactggagaggtggaggttgcagtgagccgagatggtgccattgcactccagcccgggcaagaagattgaaattccatct

SEQ ID NO: 282411 - DNA, 1063 bp, Homo sapiens
aggcgagcccatagtggctatcagcaagtgcctgccaacccagtttcagacactcatccttcatccttcctgctgccgccctgggttcctctataaacctcgctgctcagctgcccccacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagaggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282412 - DNA, 2688 bp, Homo sapiens
ggcaggctggtactggtctggaatatattggatctcatcccctcccccggccctgggtgtcccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgacgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282413 - DNA, 2242 bp, Homo sapiens
ggcaggctggtactggtctggaatatattggatctcatcccctcccccggccctgggtgtcccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgacgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgtccgctagacgataggcttattgcatacccactatggtcttcaggaatatagcgacattgatactgggtaccctagactgtaactagctgaacctgtggtgaggctaatgagccactagggggagcca

SEQ ID NO: 282414 - DNA, 1726 bp, Homo sapiens
ggcaggctggtactggtctggaatatattggatctcatcccctcccccggccctgggtgtcccgtgacgaggcagcgcggagccgccgcgggccgggcccatcccgccgcagcggcccggggccgagcaggggctaggcggggagggagcggcgcccagcggggcccggagcgtggccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282415 - DNA, 152 bp, Homo sapiens
cacttatcatggctgcacaccctggcaagtgacttttttctccccaccaggcactgagtaaccgtggtcagcacagcatctcgtatacactgtcccggagccactcggtcatagtggagtatacacatgatagcgacacagacatgttccag

SEQ ID NO: 282416 - DNA, 473 bp, Homo sapiens
tcagcaaatcaacttgtatttattgaatggggcgatccctagtgctgtgggggcaacagagaaggagaagctgctccaggccacggcttcttggacttggagaccccacctgggagcctagagggcctatggagttggtgctgccccttctccagggcctggcagcctccttttttggtgaccttgcatacagagcagctgctggtactctgggagggaaggcccatgagagtcccctatgtacatacagtccctgcttgctctccctgtcctcacagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgacgcctctagcaacatcttccttgga

SEQ ID NO: 282417 - DNA, 1040 bp, Homo sapiens
  misc_feature (12)..(12): n is a, c, g, or t
  misc_feature (18)..(18): n is a, c, g, or t
  misc_feature (30)..(30): n is a, c, g, or t
  misc_feature (227)..(228): n is a, c, g, or t
  misc_feature (233)..(233): n is a, c, g, or t
aggttcacaagnatgggnagcaagtcacangatgggaagcgtgctctatacagaagggagggcctgtgcacaggctcaggtgtcagtaagccagaaatccaggacagagtcaggatggctggagcatggactgcggggggaacagagaagggggtggagcaaaaggttgggaccatgtgaccagggaagatgctggatggaggattctgaacctcatttgtggacgnncaggngcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282418 - DNA, 2760 bp, Homo sapiens
ggcaggctggtactggtctggaatatattggatctcatcccctcccccggccctgggtgtcccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgacgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282419 - DNA, 2571 bp, Homo sapiens
cgcacaccccctttgcctttagcattttcctcctctcctctaattgcgtggcgtccccagatgaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgacgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282420 - DNA, 1203 bp, Homo sapiens
aggcgagcccatagtggctatcagcaagtgcctgccaacccagtttcagacactcatccttcatccttcctgctgccgccctgggttcctctataaacctcgctgctcagctgcccccacactccctgctggcacagcacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaaa

SEQ ID NO: 282421 - DNA, 432 bp, Homo sapiens
caggcggcttctccgaggactcagccccgggtgtctggcgggagatctcggtctgtgggaatgtgtacacattgcgggacagccgctcagcccagcagcggggcaagctggtaggtggcccgctccattccccacccctatccttgccaggccctcacaagctgcccatccccctgcccaagccaggagatgatctccagtccttctgccccagggagccccaacaggctccatatcagggaatcccaggcccagggggttcttagcatgagccacttgtcccacagacaggcagacagaccagggtccccaagcatagcatgcataccactggaggtccagggggtgatgcgatcaaggcacacacagacatactgtgcagtcccaggtggcttcaaggctgctggcagcttaaaaaaaatcacaccttct

SEQ ID NO: 282422 - DNA, 734 bp, Homo sapiens
caggcctcatctccgcaccgggagctcgggctcacactgtagaatgaagtgccctgtagaatattcgatccccacggccagctagggaccccgccacagtggagcgcctcgccacctccatccgccctcctgtggtccgggactaggtgcagttacaggacccgcctaagaagagcactagaaggacgcagtgggtggatgtccgagttcgagcggctggatgtcgcgcggtggcaacaagtagctcggaaaaggggtattgagagtccactgcgagctgcttcctgcttgcggccaatggggacgtgcggcagagcagttagaaacaagaagggagaagactaaagagagactccttacttctggcaacgagatacacaaaaggggttgcgaacatccaaaagggtcttgctccaggtagcaagtatgaattcctccatgacatctgggctacaagaaatgccaagcttggccactgctcacagtacccgggactcataagaatccatgcatgccttctcccatctaagacatgcgggatccatgccaggaagaatgaggcacatgccagaggatatgggggctgggaggagggcactaacccagagtgatttgaaatgaggtagcattcaatggcccctggcaaaaaagagaaagaagacgagggagctgaaaaatgtcttcatgggagaaaggagggagggaagacagggagggaggggtggtccaactgg

SEQ ID NO: 282423 - DNA, 811 bp, Homo sapiens
caggcctcatctccgcaccgggagctcgggctcacactgtagaatgaagtgccctgtagaatattcgatccccacggccagctagggaccccgccacagtggagcgcctcgccacctccatccgccctcctgtggtccgggactaggtgcagttacaggacccgcctaagaagagcactagaaggacgcagtgggtggatgtccgagttcgagcggctggatgtcgcgcggtggcaacaagtagctcggaaaaggggtattgagagtccactgcgagctgcttcctgcttgcggccaatggggacgtgcggcagagcagttagaaacaagaagggagaagactaaagagagactccttacttctggcaacgagatacacaaaaggggttgcgaacatccaaaagggtcttgctccaggtgaggctcgaactcacaacctcggcattgctctgcatgtactgctgtataagtaccgcgcgctaaccgattgcgccactggagctctgctgaatgggcctcgtgatggctctatcagggtgcgctggcgcccgcggcgggcctcggcagagcatgcgcgttcgcggcgcgagcccaggcccgagccttctgcgacttcgcgccgagctcccggctgttccgcagccgatcgagccggggaagcctgcgagtgtcgccctcggggatggaggggccgcctagcctggccgtgacgggagggccacgggggccctgcaaagagcgcagcgcgcagccccgggcctcgccgtaggaggagcggccccagcgcctgcggccggaaaaccccctctat

SEQ ID NO: 282424 - DNA, 737 bp, Homo sapiens
gttgtgccaccttatactcccaccagtaatgttgagagttccagttgcttgacatcctcaccaatgcttcatattgtcagtctttaattttagccattctaccgggtgtgtaatagtatctcattgtatatttaatttgcatgttaatttgcatttatacaatgcaaattaatttgcatatatttaatttgagcatgtcattaattgctcaactaatgatgttaagcaatattttgtgtgtgcttattggtcatctgtgtatctttataaaatggttgctcaaaccttttgcccattgttttgttgttttttgtttgtcttcttttttgtttttgggttttggtctttttttttaattaagttgtaggagtggctaaatgcctcgggtaagtcattgattttctgtttctttatctgtaggtagcaagtatgaattcctccatgacatctgggctacaagaaatgccaagcttggccactgctcacagtacccgggactcataagaatccatgcatgccttctcccatctaagacatgcgggatccatgccaggaagaatgaggcacatgccagaggatatgggggctgggaggagggcactaacccagagtgatttgaaatgaggtagcattcaatggcccctggcaaaaaagagaaagaagacgagggagctgaaaaatgtcttcatgggagaaaggagggagggaagacagggagggaggggtggtccaactgg

SEQ ID NO: 282425 - DNA, 362 bp, Homo sapiens
acaagggcctggaatgtgagcaggagcaagggagtgctcgggaaatggaaacaatgaatgaatcaatcagtcaatcagtggcacgttccagagccatagcctctgttctattcatctccagtctcctggggtggaagtgtccagcacagagactgccacactgcaagacgaaggggctggacacacggaagagagaggcggaaccctgcaccccctcaacctcagccctactgagtctccaatggggccacgcttctgagtgcacctccccgtgtcatctgtaatgtgagggggaaccaggcttgatatggcattcccaatccagggcctctggaccccttgagatgcataaaaatagtgat

SEQ ID NO: 282426 - DNA, 777 bp, Homo sapiens
tgtgtaactggtggtaaaactttattattcaagtttagatgtaacagacatctttgctgcctgaagattgtttgcataagaaatacaccaagaacatgtttgtgagtagaaatgaacatgcactatgaaaacaaaataaaataaaacgaaaaaatttcatgtgttgtaagaacagaactattatagccaacattctagtattcaaatcaggactacaaattgaattctttttcttagcaacatgaaatcattccatatgaaagacattttctgctggtgaatattgctgtaagttaaattttacattggcattttgagatgttcccccctcatgcctcccccaaagttttccatgtggttgtcaaatagtccgccctaaggaatttggcgtttattattgtgatatttgccttattggtagccattaagaaactatgattttatcagcctagtaatagttttgcatcttcatagtcaacactattggctgcctagttgatatttacagctcgtctttaagaaaaatgaccccaacctttcctggcctttgggaactgacagtttaaataacccccttggccacataataatacttggcactcctatggtgcctttcaaccaaggatctcaaagtgctttacaaacaagtactacattaccattattattattaataatattattaatacatatatttttcaattttacagctgaggaacctgaggcacaaaaagaaaaagtgatatgctgcagttcatatgttgggaaaaaaaaaaa

SEQ ID NO: 282427 - DNA, 215 bp, Homo sapiens
ctctttctaggttttggagtgtttttgtcatgaagaagtgactaacattgtcaaaagctttttgtgaatctactgagataatcacgtgaattttgccctttattccattgaagccgtaagttgagagaagaaccagctgttgcttcatctgaggaacctgaggcacaaaaagaaaaagtgatatgctgcagttcatatgttgggaaaaaaaaaaa

SEQ ID NO: 282428 - DNA, 2630 bp, Homo sapiens
gggtctgggagtcccttagtgaaagagactgggagtcacgtactaggtaagctggcacccggggccagggcacttgaaatcttccaatcaaggtgactagtactactccaggttatgcaggaatcatgcctaaaatctcatcatccttcaacccacccataggacagacctggaggtggtatatactatctgcaaactaatataccacttttccttttatttgattttctgtcctccctattctgcccaatccgcatggtttgaaattgagcttatggcccattgtcttctttctctccttgagtttctcccaagctggttttagcttggtgggacaaatcagagaaaggtatagtgtgtgtacttctcctttgtgtttgcatgtttgcacttatgggtgcttacacccactctatgcagagacatcccagcctcgaccacaggatctggagccacctctaccctgagctgaaagaggaattttttttttttttttgagacagtctcactctgtcacccaggctggagtgcagtggcatgatctcagctcactgcaacctccgcctgccgggttcaactgcaacctccacctcccgggttcaaatgattctcctgcctcagcctcccgagtagctgggattacaggcgtccaccaccatgcctggctaattttgtatttttagtagagatggggtttcaccatggtggccaggctggtctcgaactcctgacctcaagtgatccacccacctcgccctcccaaagtgctgggattacagatgtgagacaccgtgcctggtggaaagaggaatcttggctgggaccctagcatcgtctagggaacagagaggttgtgattaagaggtatctggatgaaatcttggtgaaaggaagcacttgtttttaatcccaccatggtttttcatatgcatacaaccatcctcaaccatctgcccatcagcagagctcctagaaaggcaggacataccactggatatccccttctggcagttctaaaccagccttgcccggaagtgggagccttatctatgtggcccagactcaaataaggcctcttggaaatactctcacccttcccctttgtttaccctccaacccctgtgaatcttgtgaacagagggttgaagaaacatgttctgcacatgtgctagtacctgtgaatcttgatgtcccctggaccctctgtgtaagtacatcatggcagaattgctctagatccttcggagctgcagggtgagttaccagccactcaaggtggaggcaaacatgccaggctgcacaagggaccaggagcagctctgcctcttcccttgcaggaggaaatgagaacggggctatacttaggtacttcatcattcctttaactcaccatctgtacctgacatattttgttttgtctcacctaaagtcatatcagacttcctacctgatcactctcattgtgactgattctgccatccaaatgtctaatttttcacagctagagaaactaagagataggaagacaagggccatgaactaagaaggggaactcctctcctgagaattattgaccctctatcagctacaagtctaagaatttctaacttctgcttcatcttctaccatttctaatagcttccccaccacctcagccttctctccccagtttcttattccatgccactggctggtaacatctaactcctagttttcagatgatcctaaactgctgctgttaatggcaaagcttcatgacatcctcaccaccagagggaaaagggtctcatgctcttctttctcttggggtatatggtgaccccagctgaaatttcttggcccctaaatttcgctaggctcccctggggccctgtggtgcagtgtgttggaagactgtcatgtagtgcatgtgacaatttgctaataacaattttgtcttttttttccctccctcatccccattcccccactccctttccttttaactcttttgattttctcacctctggggaaaccacaaggagctggtaagaagcctgacctttcatctgctttttaacggggtgtgctatgatgagcagttgtttctctgtcctttagactctactaaatctttcattcatctattcagtcccacacccagccttttcctatctcacaagtcactgtaattatactgcccccaactcatgccccagatcttcaagacactgctggagtaggtgctactggaggactagagtgtgctcccgggccacagccttggagaggctccagaggatgccagcgccaggtagcccaactggcccaggacactctcccacagcaggaatgaaaatgctctctgtccctgtgactgtccagaacctctgagactcaccgtctatgtgttgaccctcttctactccccgctttccctacttaggaacgtaaataagaaagtaggttccatctgcatagtgcccgcccataataagggcttaacaaatggtagctatgattaatttttttcctgggtctgtaggttatgcctcccattcctcttttttaagaggattaaacaaaagaggatgggtgggattggcctggattggggctttcacagggagaagtggcatattcctgagtat

SEQ ID NO: 282429 - DNA, 406 bp, Homo sapiens
agtgctgggattacagacgtgagccaccatgcccagcctcagtcaccttcttaacccctgacaacagcattctccgccttaatcttcagtttattttcaactttaattttatcagtttttaaagtaggtaatgtatgcacagggaacagaggattcaagggtaagtagtgaaaaatctgcctcccacctctgcctaccaccactcagttctcttccctagagacaaccaatatggatagactcttgtggaacctttcagggggtctccagatttctttttggtttttgagacagagtctcactctttcccccaggctggagtgcagtggcacaatcttgtctcactgcaacctttgcctccccggttcaagcgattctcctgcctcagcctcccaagtagctggaa

SEQ ID NO: 282430 - DNA, 360 bp, Homo sapiens
cctgatttttctactatccctttaaaacaattttagcaggaagtaaaatcttctaaaacaggaatggaccaggaaagtgcacgggctgtagccctttcctcctcaatctgggaagatctctttgcacttcagacactcccaggttaattggggcaataggcttgcttggagatttttcttaaaatgtttggaaaactaattcccaaatagaattccacccacacacacaccatgccaactcatgtccaatactgctttgcctggtgtggggaaggattgggtcttgtcccccaacacagcttctgtggctgactgtaatactgtacaactgtttctgaccattaaatgctgttgtactct

SEQ ID NO: 282431 - DNA, 536 bp, Homo sapiens
aaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcccgtctctaagtgaattaaaacgctcagagctcaacaaaaccctgcaaaccctaagtgagacttactttataatgtgtgctacagcagaggcccaaagcacattaaattgtacattcacaacaaaactgaataatacaatgaatgcatgtgctgtaatagctgctttggaaagagtaaagattcgaccaatggaacactgctgctgttctgtcaggaagcagcactaggatatagatattcattcgtcataacaggcaatctaagccactctatactacaagagatggatttaaattgtaacctgttcttaccaaagaactaaataaaaaatgagtacagagccagag

SEQ ID NO: 282432 - DNA, 2668 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282433 - DNA, 2394 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggctgcctcctgcctttttttttgtaaa

SEQ ID NO: 282434 - DNA, 2294 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctctttcactgggaaggagggcagcagccaacagtagctcacaggtttgtaaactgagcctgttggccactgtccacaggtgcaggtggctggcaggggctcccaaggctcagcactcagctctccccaatcagggtcagatccagcttc

SEQ ID NO: 282435 - DNA, 2229 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctcactgtccacaggtgcaggtggctggcaggggctcccaaggctcagcactcagctctccccaatcagggtcagatccagcttc

SEQ ID NO: 282436 - DNA, 2411 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282437 - DNA, 2080 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagaaaaaaagatatctataataaatttgctaattgattaatataattcattatattatgtattaattcagtattatcatttacatatgtattgtataattattttattatatgaaaaaaaattccggggggcggccccattctcacaatttaac

SEQ ID NO: 282438 - DNA, 2633 bp, Homo sapiens
ccagaggatgctgtataggtcgtgcctgggtgttatttcgctgccggcgtcaggccgtgttacctgatacaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282439 - DNA, 3990 bp, Homo sapiens
aggtgcagtttgcaagatcatagctcactgctggtctcgaactcctgacctcaagtgatccacccacctcgccctcccaaagtgctgggattacagatgtgagacaccgtgcctggtggaaagaggaatcttggctgggaccctagcatcgtctagggaacagagaggttgtgattaagaggtatctggatgaaatcttggtgaaaggaagcacttgtttttaatcccaccatggtttttcatatgcatacaaccatcctcaaccatctgcccatcagcagagctcctagaaaggcaggacataccactggatatccccttctggcagttctaaaccagccttgcccggaagtgggagccttatctatgtggcccagactcaaataaggcctcttggaaatactctcacccttcccctttgtttaccctccaacccctgtgaatcttgtgaacagagggttgaagaaacatgttctgcacatgtgctagtacctgtgaatcttgatgtcccctggaccctctgtgtaagtacatcatggcagaattgctctagatccttcggagctgcagggtgagttaccagccactcaaggtggaggcaaacatgccaggctgcacaagggaccaggagcagctctgcctcttcccttgcaggaggaaatgagaacggggctatacttaggtacttcatcattcctttaactcaccatctgtacctgacatattttgttttgtctcacctaaagtcatatcagacttcctacctgatcactctcattgtgactgattctgccatccaaatgtctaatttttcacagctagagaaactaagagataggaagacaagggccatgaactaagaaggggaactcctctcctgagaattattgaccctctatcagctacaagtctaagaatttctaacttctgcttcatcttctaccatttctaatagcttccccaccacctcagccttctctccccagtttcttattccatgccactggctggtaacatctaactcctagttttcagatgatcctaaactgctgctgttaatggcaaagcttcatgacatcctcaccaccagagggaaaagggtctcatgctcttctttctcttggggtatatggtgaccccagctgaaatttcttggcccctaaatttcgctaggctcccctggggccctgtggtgcagtgtgttggaagactgtcatgtagtgcatgtgacaatttgctaataacaattttgtcttttttttccctccctcatccccattcccccactccctttccttttaactcttttgattttctcacctctggggaaaccacaaggagctggtaagaagcctgacctttcatctgctttttaacggggtgtgctatgatgagcagttgtttctctgtcctttagactctactaaatctttcattcatctattcagtcccacacccagccttttcctatctcacaagtcactgtaattatactgcccccaactcatgccccagatcttcaagacactgctggagtaggtgctactggaggactagagtgtgctcccgggccacagccttggagaggctccagaggatgccagcgccaggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282440 - DNA, 2599 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282441 - DNA, 2763 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgatcttcaagacactgctggagtaggtgctactggaggactagagtgtgctcccgggccacagccttggagaggctccagaggatgccagcgccaggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282442 - DNA, 2617 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282443 - DNA, 2056 bp, Homo sapiens
  misc_feature (1775)..(1775): n is a, c, g, or t
  misc_feature (1778)..(1779): n is a, c, g, or t
  misc_feature (1880)..(1880): n is a, c, g, or t
  misc_feature (2001)..(2001): n is a, c, g, or t
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctaaaaaaaanaannaaaaaaaactttttgcgcgctggacctcgaaagtttctaaaccatccggtggggggcggccaggtgtaattggacctggcaaagcgtctccaggaaatcgnggcctggcaaggggcgggttttccccataaaaaaacgcgcgcgaccggttttcgaacaccccgaggctcgggcccacggtctccacgggtgcacgcgctagccccccgccgcgggcgcggncaaaatcccaacccagaacaaacgaccacacaaaacacgagcaagcacaaagaac

SEQ ID NO: 282444 - DNA, 1930 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctaaatatacttcaaggatgagactcgagggggggcccgtgacccaagtcgccctatggcagagatcggatccaatgcacatgccagagatctacaatgtcaccactgggaacaccctgggatcacccactttaatcgcctggcagcacatccgcgttacgacagc

SEQ ID NO: 282445 - DNA, 2602 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaaaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282446 - DNA, 1734 bp, Homo sapiens
  misc_feature (27)..(27): n is a, c, g, or t
  misc_feature (29)..(29): n is a, c, g, or t
taacggctaggtacgaggctgggtggngnaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282447 - DNA, 1980 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282448 - DNA, 987 bp, Homo sapiens
  misc_feature (956)..(956): n is a, c, g, or t
  misc_feature (971)..(971): n is a, c, g, or t
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggttctacaggaaccttttcccntgaaaatgttaaacntttgcaacaaggttaa

SEQ ID NO: 282449 - DNA, 1553 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282450 - DNA, 651 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgatgccaactcatgtccaatactgctttgcctggtgtggggaaggattgggtcttgtcccccaacacagcttctgtggctgactgtaatactgtacaactgtttctgaccattaaatgctgttgtactct

SEQ ID NO: 282451 - DNA, 1947 bp, Homo sapiens
aggtgcagtttgcaagatcatagctcactgctggtctcgaactcctgacctcaagtgatccacccacctcgccctcccaaagtgctgggattacagatgtgagacaccgtgcctggtggaaagaggaatcttggctgggaccctagcatcgtctagggaacagagaggttgtgattaagaggtatctggatgaaatcttggtgaaaggaagcacttgtttttaatcccaccatggtttttcatatgcatacaaccatcctcaaccatctgcccatcagcagagctcctagaaaggcaggacataccactggatatccccttctggcagttctaaaccagccttgcccggaagtgggagccttatctatgtggcccagactcaaataaggcctcttggaaatactctcacccttcccctttgtttaccctccaacccctgtgaatcttgtgaacagagggttgaagaaacatgttctgcacatgtgctagtacctgtgaatcttgatgtcccctggaccctctgtgtaagtacatcatggcagaattgctctagatccttcggagctgcagggtgagttaccagccactcaaggtggaggcaaacatgccaggctgcacaagggaccaggagcagctctgcctcttcccttgcaggaggaaatgagaacggggctatacttaggtacttcatcattcctttaactcaccatctgtacctgacatattttgttttgtctcacctaaagtcatatcagacttcctacctgatcactctcattgtgactgattctgccatccaaatgtctaatttttcacagctagagaaactaagagataggaagacaagggccatgaactaagaaggggaactcctctcctgagaattattgaccctctatcagctacaagtctaagaatttctaacttctgcttcatcttctaccatttctaatagcttccccaccacctcagccttctctccccagtttcttattccatgccactggctggtaacatctaactcctagttttcagatgatcctaaactgctgctgttaatggcaaagcttcatgacatcctcaccaccagagggaaaagggtctcatgctcttctttctcttggggtatatggtgaccccagctgaaatttcttggcccctaaatttcgctaggctcccctggggccctgtggtgcagtgtgttggaagactgtcatgtagtgcatgtgacaatttgctaataacaattttgtcttttttttccctccctcatccccattcccccactccctttccttttaactcttttgattttctcacctctggggaaaccacaaggagctggtaagaagcctgacctttcatctgctttttaacggggtgtgctatgatgagcagttgtttctctgtcctttagactctactaaatctttcattcatctattcagtcccacacccagccttttcctatctcacaagtcactgtaattatactgcccccaactcatgccccagatcttcaagacactgctggagtaggtgctactggaggactagagtgtgctcccgggccacagccttggagaggctccagaggatgccagcgccaggtagcccaactggcccaggacactctcccacagcaggaatgaaaatgctctctgtccctgtgactgtccagaacctctgagactcaccgtctatgtgttgaccctcttctactccccgctttccctacttaggaacgtaaataagaaagtaggttccatctgcatagtgcccgcccataataagggcttaacaaatggtagctatgattaatttttttcctgggtctgtaggttatgcctcccattcctcttttttaagaggattaaacaaaagaggatgggtgggattggcctggattggggctttcacagggagaagtggcatattcctgagtat

SEQ ID NO: 282452 - DNA, 1630 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgtgagtacaggaccggccccggctccccaggaccgcgcccccgacctcccaaggacccccaacagaaaccagcccgcgacccctcccgcctgcagcccatcctccgcccaagggctcccgccgctcgttctccgatcggcctcagcaccccccgaactcttctgacccgactgggccgggccgccggacggcgcaccaggccccctttccggcagtcgccggtagctcggcccagaaatcgactccgggccaggaatgagccagatgtttatgaaactagcgacctacctgaggatgatcaagcggagttcgatgcgagaatgtgtgctgccacagactcctccggactctgacctttctcccctagacaggtccttccctttctcgggggagctacagcaataagcgggtatgccaaccccagcctgggtggtatataggttgcagggcttgcaaagaccttgctgggcttgcagccaccaatgagcaatggcaggagggagagtcaagtcagcggaattacagctaacaacatctgtttgcaaagccctgattcttgggccttttaaataaaattgaaatatctcaaaacaggtttggagctagtgacttaggcccctgggttctaacccatggaaatgaatcatgaagcctgggcacttgtaataaactgctaccaagaactagactttgaaatatggagaaatactttttccatatgaatatccagtatccattgggcaaggaattaagaaagtgattccaagattttagagcaaaacaaatttgaggaagaatgtaaatatttcacatcagcggatgtgagactgtggttgcatttttagatccgagaattctgaggatggagtaattaggtacggatacattttaactgtgaggggaaacatttagtatggtttattgagtgtgttcattctgtggttttttttgtgcaatgcagaggaagaaatgtctctgcccccaatgagccccagactaatggggaattaggatacatataggaaacatatagaaggaaaaaaaaattgagtgaatggaaatcaacatagtaaaaactctgtttaagtgccaagaggtgtgtttataggatgtgttttaggttctattatttctgaagacagctgggctgggatcacattgatgatgtgagttctcagtaaagatgtgtccaagagtcattgcaatatgcaggctcagtatgcttgtctgtaagtcctgtggctatgtctgtggggctggttaattctggggaatgctgactgctggcttacaatgtgtggcttggcgtactcacttatttcttatttgactcccccatgtggaagtggttcttacattgtgggaaacaccttctctgtcccttctcccagtggtgtgttccttgtggctt

SEQ ID NO: 282453 - DNA, 504 bp, Homo sapiens
  misc_feature (27)..(27): n is a, c, g, or t
  misc_feature (29)..(29): n is a, c, g, or t
taacggctaggtacgaggctgggtggngnaacccagcctctcccctacccgaacaccggccccggctccaccgaggcccgggtcccccagcccgtctcgccgccgccatggcggaccctaaatacgccgaccttcccggcattgtgagtacaggaccggccccggctccccaggaccgcgcccccgacctcccaaggacccccaacagaaaccagcccgcgacccctcccgcctgcagcccatcctccgcccaagggctcccgccgctcgttctccgatcggcctcagcaccccccgaactcttctgacccgactgggccgggccgccggacggcgcaccaggccccctttccggcagtcgccggtagctcggcccagaaatcgactccgggtactgacctcttgtgcctgagtttttccaccatccgtgtcaacgcctcccatgtcccccccaaatctctccataagaccccatcgctaccccagacacacacaccagaccac

SEQ ID NO: 282454 - DNA, 127 bp, Homo sapiens
agaagacgataatcatggagatataaggaccactcacttcttcccttcctttcccaccaaatcccctttctgcaggtctacagggagcctgtctcatggtgagtttggaagaaactggagtgtttgg

SEQ ID NO: 282455 - DNA, 214 bp, Homo sapiens
gcttgaaaattggtgctataaacatcccccctctgtggcccacaaattgtgcttccatttcttgtcttctctctcagagaattccttcaggtcctcatccagttaagcaactggacctgacaaagagtaaaacctctctaccactttgtaggtgcagacaaccatgcgtgaaaacctggccacagttgaggggaactttgccagcattgatgaa

SEQ ID NO: 282456 - DNA, 409 bp, Homo sapiens
actggaggataagcatgagaagtggtttcctgtcctaaagtcttagtgagttgtgcttgggggaaggggtccctcatggagatattttatggaagccctcacagtcacctgagaccatgactgccttgggcctagatcaggccctcagttccatcttcttttcttggcagatttctcagatcgtattggaaaaaccaagaggacaggatatgaatctggagaatatgagatggtttgttgtgtgtgtgtgtgtgttgatgggaatggtgtagtgaccctatctagcagacatgtagtagggagatcaagggatacaggcgggattctgttcctcctctgttcctgaggaagcagcaggatgcagccagggaaactctgccctactgctgtttgttctggagagcctcca

SEQ ID NO: 282457 - DNA, 1928 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagag

SEQ ID NO: 282458 - DNA, 2621 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282459 - DNA, 2297 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcaagggagaggcaaggccccaagcatcccagggaagccagctccactcagtgccaggccctgctcagggctggggaaagggaaagcctctccaccagccaggggaggcagagggcaggccggcctgcccccatccccagtccttcggatgggctttgaagcacagggctggggactactggggctttggaggcagctggtggggcaggggcacctgtaaaagaggagagaaat

SEQ ID NO: 282460 - DNA, 2592 bp, Homo sapiens
  misc_feature (27)..(27): n is a, c, g, or t
  misc_feature (29)..(29): n is a, c, g, or t
taacggctaggtacgaggctgggtggngnaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282461 - DNA, 2916 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgtgagtacaggaccggccccggctccccaggaccgcgcccccgacctcccaaggacccccaacagaaaccagcccgcgacccctcccgcctgcagcccatcctccgcccaagggctcccgccgctcgttctccgatcggcctcagcaccccccgaactcttctgacccgactgggccgggccgccggacggcgcaccaggccccctttccggcagtcgccggtagctcggcccagaaatcgactccgggccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282462 - DNA, 2634 bp, Homo sapiens
  misc_feature (27)..(27): n is a, c, g, or t
  misc_feature (29)..(29): n is a, c, g, or t
taacggctaggtacgaggctgggtggngnaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggagctggtaagaagcctgacctttcatctgctttttaacggggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282463 - DNA, 1766 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactct

SEQ ID NO: 282464 - DNA, 1806 bp, Homo sapiens
  misc_feature (1778)..(1778): n is a, c, g, or t
  misc_feature (1784)..(1784): n is a, c, g, or t
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctaaaaaaaaaaanaacaanaacacaacacacacacaacagg

SEQ ID NO: 282465 - DNA, 2883 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagggtcaggtgttctcctgtacataatctgagccttagatcctgcaactctaggccttaaggtctacaacattccacataagcctgggaggagtcatcaaagggcttcagttacagggatcagctagtgggttcccagctagaaccaggaaagatgggagaagacgataatcatggagatataaggaccactcacttcttcccttcctttcccaccaaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282466 - DNA, 1811 bp, Homo sapiens
  misc_feature (27)..(27): n is a, c, g, or t
  misc_feature (29)..(29): n is a, c, g, or t
taacggctaggtacgaggctgggtggngntggagacagctgtacgttgtgatcaggatgctaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282467 - DNA, 2226 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagggtcaggtgttctcctgtacataatctgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282468 - DNA, 1371 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagggtcaggtgttctcctgtacataatctgagccttagatcctgcaactctaggccttaaggtctacaacattccacataagcctgggaggagtcatcaaagggcttcagttacagggatcagctagtgggttcccagctagaaccaggaaagatgggagaagacgataatcatggagatataaggaccactcacttcttcccttcctttcccaccaaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtcaggaagacaccttccccatctcctttccactccctcaggttctccg

SEQ ID NO: 282469 - DNA, 1030 bp, Homo sapiens
gctgtcggattcggcggctgggtggcgctggttgtggtggtcccgccgcgttgcgtctcgtgtcgtcccgttggcattgtggctgcgtcgctctgtgcggcttgtcgttgggttgttgctgcgtactccgcgctggtccctctatgtgtcgttgcgtgtggctgccttttttgggtggctctgtctttgtcatgttgtattgtgcttgtttttttttttttttttttttttgttttgttttttttttgttttgcttgtttttttgttttttttttttttttttttttttgccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacctggggacggggtaagagaggatctgtgctttgagcaacctgagccagaggcagaggggtgttggaggggtaaggggaggatgcatgatgcttattgctttgtacctttcactgggaaggagggcagcagccaacagtagctcacaggtttgtaaactgagcctgttggctttaagaagggaggcaatgaaatcgaattaaatataaaagagtcatttgtgcaaaaataacttaaacaaataaaagacctggggaagggggtgttccccttagcgcctggtggggaaagggccatataccatcccccccaggccttttcagtgacatggcttcgggggggcggcaagggtggtgggggggggtgaacttc

SEQ ID NO: 282470 - DNA, 736 bp, Homo sapiens
cggacgcgtgggtcgcggacgcgtggccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagag

SEQ ID NO: 282471 - DNA, 2272 bp, Homo sapiens
gcttgacgcacggagcttgtctgcgccggccagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgattgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacatactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcga

SEQ ID NO: 282472 - DNA, 985 bp, Homo sapiens
attttttggtaaggaatgactttattcacaggaacactgcagtaagggaggaggtgttgtaattgggagaatactccagccataagatctgcaagcatagcaaaggtcaggcataaaggaattttcttttatagggaagagtaaacaggcaagaaagaactagattcaggggagtgggatgagactgttttggatctgttgaccctgatatgtctgtcaaaatgtctgtgagtctagctgatgttcatgacgtctgaaagaaggccacattttggtctctgaagccccttcctaagattgggagcaaagtacctgacttagtgtttgggtccaggaggatggtggggggctccctgggcatgcctctgttctactgtggaagaggagatgccatgggaaagtaacagcacctagggtcctgttcaacatggacattaaggaaaggtctgcctgaaccccttctgcagtagctggcttccattgggtttgtggaagaactgagattttttccaaattcccaaaagaggagaagtaaaggtagttctaagtagtttattttgtgggctgtgagccaagtctaatcttgtggctttttttccttgtccagcactggcttctctggactttgcacacctccaggagaagaacccagaaaattgatcagttctaaaaaaccatgccccacgtgagttgctgtttctttccttcttgaagtacaatcattttgttgtgtaatgtgaacaccagatttatcccagaatttcctgccttgtttggttccttaagggaactgcttccaaacgtctcccattctagcgagtaatagtagcaaagagcccaattcttctcaatgcttttcccctctccaaacagttttcagatattcattcagcagataattctacattgtccacaggcatagtcttctgcccagagctctgagggaacagaaatacctccttttaagattggtacacattagtac

SEQ ID NO: 282473 - DNA, 1099 bp, Homo sapiens
attttttggtaaggaatgactttattcacaggaacactgcagtaagggaggaggtgttgtaattgggagaatactccagccataagatctgcaagcatagcaaaggtcaggcataaaggaattttcttttatagggaagagtaaacaggcaagaaagaactagattcaggggagtgggatgagactgttttggatctgttgaccctgatatgtctgtcaaaatgtctgtgagtctagctgatgttcatgacgtctgaaagaaggccacattttggtctctgaagccccttcctaagattgggagcaaagtacctgacttagtgtttgggtccaggaggatggtggggggctccctgggcatgcctctgttctactgtggaagaggagatgccatgggaaagtaacagcacctagggtcctgttcaacatggacattaaggaaaggtctgcctgaaccccttctgcagtagctggcttccattgggtttgtggaagaactgagattttttccaaattcccaaaagaggagaagtaaaggtagttctaagtagtttattttgtgggctgtgagccaagtctaatcttgtggctttttttccttgtccagcactggcttctctggactttgcacacctccaggagaagaacccagaaaattgatcagttctaaaaaaccatgccccacgtgagttgctgtttctttccttcttgaagtacaatcattttgttgtgtaatgtgaacaccagatttatcccagaatttcctgccttgtttggttccttaagggaactgcttccaaacgtctcccattctagcgagtaatagtagcaaagagcccaattcttctcaatgcttttcccctctccaagatgtggctttaatgtttatagtttattatagcctaatttgattttgctgcttttaggggtgaagactctacatgagtttcttggttatagagagtctttgtatgctgactttctcagatgctgattgtagtagttttgtactcggggtgtgggcaatttcattgtctcctgtggaattggaatggcaaggatctcttgaagcttatctcatttccccgccggaaaggct

SEQ ID NO: 282474 - DNA, 2220 bp, Homo sapiens
ctcatttcacttcagaatcattcctgtagaatcatcctgtaatggatttgttgtttcagttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgattgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacatactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcga

SEQ ID NO: 282475 - DNA, 2127 bp, Homo sapiens
cgggggcggggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282476 - DNA, 1439 bp, Homo sapiens
gcaccggttaattatacgtggctggcttccttcagctgcgtccccgtggcgtcgacaacactttctgcctcaaggaatccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282477 - DNA, 2891 bp, Homo sapiens
cccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagccttgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaaggtgaggcccttccctcagcagtggcactactccaccccaggaatctccaccagctgtgcctctgccctggggtactcagtagatgctaagtggggagagagacacgtgcaagcccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcgaaaccccgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaaaaaaaaaaaaaaaggtaagcaggtctttcaaggcattccaagcataaggaagagcatgaatgaggcctagaaggatgccagtgcccgaggtgacgtgggagcccttttcccagagttacatgctgggcccatgatgggtgtgggcctgcatgggacaggagagcttgttgcagagatatgatgctaggctgaggtgtcttatcccatgcagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282478 - DNA, 2214 bp, Homo sapiens
cgggggcggggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggtagttcccagccttgggacagggaagggctctgggatggcaggagctgaatgggatgacctagcttgggccccctcccctgcccaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282479 - DNA, 2178 bp, Homo sapiens
cccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagccttgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282480 - DNA, 2971 bp, Homo sapiens
cccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagccttgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaaggtgaggcccttccctcagcagtggcactactccaccccaggaatctccaccagctgtgcctctgccctggggtactcagtagatgctaagtggggagagagacacgtgcaagcccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcgaaaccccgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaaaaaaaaaaaaaaaggtaagcaggtctttcaaggcattccaagcataaggaagagcatgaatgaggcctagaaggatgccagtgcccgaggtgacgtgggagcccttttcccagagttacatgctgggcccatgatgggtgtgggcctgcatgggacaggagagcttgttgcagagatatgatgctaggctgaggtgtcttatcccatgcagtctttcctgtctgtcttccgctcactggcgatgctggagaagacggtggaaaaatgctgcatctccctgaatggccggagcagccgcctggtggtccagctgcattgcaagttcggtgagtgggcagccggccagccaaggggtgcctcagcagggaggtcggcgaggcccactgagaccctatcgcccatccaggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282481 - DNA, 1846 bp, Homo sapiens
cgggggcggggccggcaggggcggtgcgcgggaagggaccccggacccggaggtcgcggagagctgggcagtgttggccgctggcggagcgctggggcagcatgaagtgcctggtcacgggcggcaacgtgaaggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcgacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282482 - DNA, 2978 bp, Homo sapiens
cccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagccttgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaaggtgaggcccttccctcagcagtggcactactccaccccaggaatctccaccagctgtgcctctgccctggggtactcagtagatgctaagtggggagagagacacgtgcaagcccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcgaaaccccgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaaaaaaaaaaaaaaaggtaagcaggtctttcaaggcattccaagcataaggaagagcatgaatgaggcctagaaggatgccagtgcccgaggtgacgtgggagcccttttcccagagttacatgctgggcccatgatgggtgtgggcctgcatgggacaggagagcttgttgcagagatatgatgctaggctgaggtgtcttatcccatgcagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggtagttcccagccttgggacagggaagggctctgggatggcaggagctgaatgggatgacctagcttgggccccctcccctgcccaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 282483 - DNA, 5630 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaa

SEQ ID NO: 282484 - DNA, 2134 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccg

SEQ ID NO: 282485 - DNA, 1039 bp, Homo sapiens
attaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaactccctcgcagggcctatggccctggacttctaggctgagaagaggccaggtgggccgggccacttttgctggaatttgataagcttggtgatctagaggcgttaaaccgactgatgcctggatcctttccttctgactggggctcctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaagaataattactgtgcatttcttggaaaaaatgtaaaaaaaagtctaaacccaaatagtaacctgtttaaaatagaacaaagacggtgaagaaaagtacccggatgttaggatattacct

SEQ ID NO: 282486 - DNA, 464 bp, Homo sapiens
ggtcgctctagaggatccctcagacagcggacccccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtccggctgtctaatcaagcttataactaccctgggc

SEQ ID NO: 282487 - DNA, 223 bp, Homo sapiens
gacgagctcggtaccattatgattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtcaatctaacaagtctgtcaatca

SEQ ID NO: 282488 - DNA, 1490 bp, Homo sapiens
aagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgttgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggaaggcttggaatgctttttactgttgctcaggaatcgttttatgctagctaagcatgcaacttccatttcctg

SEQ ID NO: 282489 - DNA, 335 bp, Homo sapiens
ggtactgatgttatcgcccaacaccctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttgggataacatcgggatcctctagatcgcccagcag

SEQ ID NO: 282490 - DNA, 5490 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcatataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282491 - DNA, 5992 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaacccacacccacaacaaaaaaaaaacaaacaacaacaaacgacaaacaaaaacaacaagcacaacacaaaaaaaacagtctgtgggcggcggcgcgcgcgcccacaagaagactagacctaaagcaggcagtgggggggcgggcggccccaaggaggaaggaacagcggagcgcagcaggtcgcccaaggcacacctgggaaaaaacagcgggggggggagaatgagcgacgcaaaaagaaacacacgcggggcgggcaccccaagcgggtgggagacacaccgtcggcagagaagaacagggggggacacaacggggtataccaaaaggaggggaagcacgggggcgcgcgaaaaagccg

SEQ ID NO: 282492 - DNA, 5947 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaaaaaaaaaaaaaaaaaaaaaaaaaaaaaaaaaaaaaaaattaaaaaaaaaaaaaaaaaaaaaaaaaaaaaaacatgccgcccgcttggcccaagccaatttaaaattggacaaagttaatccatgcgcccgaatttggacctaattggccaaattcccctaaaagggggccgttttaaaatcaatggcccgtgttttaaaaacgtcgtaactggaaaaaccttggggtacccaacttaaatccctttgaagaaaatccccttttcccaagttgggaaaccggcccccaaccccgcctttcc

SEQ ID NO: 282493 - DNA, 3952 bp, Homo sapiens
actgacctacctatactacctatctatactgacttatttatactacttatctatactgacctacctatactacctatctatactgacttatttatactacttatctatactacctatctatactgacctacctatactacctatctatactgacttatctatactgacctatctatactacctatctatactgacctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282494 - DNA, 3202 bp, Homo sapiens
taaaaatcaagataatcggttattactaatctttgctataaggaaaatgcaattttaaaagttcttgtatggcttagttttcattgctctgctctgaatgagctatataatgggtctttttgcttctttctctgttcttcagtgtcacttattccttcaagatgtgctgactaccatgttttaggaacagagctggaggctagggatacaggaataagatttgatctctgatctcagtatgcccacagtttggtggggatacagaggaacaaagaaagcatatttctctttctctgagttttaaggtcagagtgggaatgaattacttagtcctatgagtaaatcaataaacttgaatttagagtgataatacttgctggttttacacttacttctgtgcctttggcaggagagaggcaaatattgttgattatgtgaatctggcactgtttgggaggatatgctcaagaggcttgtatggtaatgacaaagaattacataaattggaactattttggatataattttttcaggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282495 - DNA, 2262 bp, Homo sapiens
cagaggatccctacctaaatggctgtagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282496 - DNA, 2993 bp, Homo sapiens
aagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgttgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282497 - DNA, 2850 bp, Homo sapiens
acacacattaacagtttaaaggtaaatgtatttttgcaaaagaagagaaattagggagtgctctgaaattcagtgtagtgatgcacttctgaagtcctatgcagcacatgatttttattgcaggaaacagttactatgtgattaatgaaatagcttaattagaagcacaatagcaaatccaggcaacataaatgacctcctggctaatgagagaagtgatatgtgtactagagcctcagaggagagaaaaagattataaagttgacctgttggaacactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282498 - DNA, 2600 bp, Homo sapiens
ttctcctctctttgctttgtcccccccactctgatacgattcgagctcgtaccccaacgatgtcctcagctcacttccctattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282499 - DNA, 1095 bp, Homo sapiens
ggtcgctctagaggatccctcagacagcggacccccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282500 - DNA, 1114 bp, Homo sapiens
cccgggctgcaggaattcggcacaggtggggtggaggctgtcatgaaggagacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282501 - DNA, 590 bp, Homo sapiens
ctagaggatcccccggaagcacactgcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282502 - DNA, 4045 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggaaggcttggaatgctttttactgttgctcaggaatcgttttatgctagctaagcatgcaacttccatttcctg

SEQ ID NO: 282503 - DNA, 2780 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcaggttaataaacttaggtaaacctcttacaaacctcggctctaccttgtctaattcattaggataacacgttcgcgag

SEQ ID NO: 282504 - DNA, 1812 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaactccctcgcagggcctatggccctggacttctaggctgagaagaggccaggtgggccgggccacttttgctggaatttgataagcttggtgatctagaggcgttaaaccgactgatgcctggatcctttccttctgactggggctcctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaagaataattactgtgcatttcttggaaaaaatgtaaaaaaaagtctaaacccaaatagtaacctgtttaaaatagaacaaagacggtgaagaaaagtacccggatgttaggatattacct

SEQ ID NO: 282505 - DNA, 578 bp, Homo sapiens
gacgagctcggtaccattatgattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctaaaaaaaa

SEQ ID NO: 282506 - DNA, 687 bp, Homo sapiens
  misc_feature (36)..(36): n is a, c, g, or t
  misc_feature (110)..(110): n is a, c, g, or t
  misc_feature (151)..(151): n is a, c, g, or t
  misc_feature (172)..(172): n is a, c, g, or t
aaaaactatccaagttgtaggtatggttatatgggncaatgaacattctccatacacttggtgaaaatacagttatgaaggcctttgggaagactgaaggtggacagagnacaaaccctttgaaccaaaaatccaccttactggactccangactctgccgaattcggcacnagtgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaaaaaaaaaaaaaaaaaaaaaaaaaaaaaaaaaaaaaaaattaaaaaaaaaaaaaaaaaaaaaaaaaaaaaaacatgccgcccgcttggcccaagccaatttaaaattggacaaagttaatccatgcgcccgaatttggacctaattggccaaattcccctaaaagggggccgttttaaaatcaatggcccgtgttttaaaaacgtcgtaactggaaaaaccttggggtacccaacttaaatccctttgaagaaaatccccttttcccaagttgggaaaccggcccccaaccccgcctttcc

SEQ ID NO: 282507 - DNA, 541 bp, Homo sapiens
tagatgataacagaaaattttctttatttgctgaaagaaaataccagactcttgtaagtatttttcaagagctgtgaatatttgagaggatgaggggaaggatttcttcagaacaatgtcttttgatgaccattcttctttttctctctagaactgtagcgtgaacgtgaactgtgtgaacatcagatgcccgctgcgggggctggacagcaaggcgtctcttattttgcgctcgaggttatggaacagcacatttctagaggtatgaccttggcttgaggctgtcccatggaagtaatttgcctttgcctaggacacttttcacttccctaatgcattcactgtctccaaacaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttgg

SEQ ID NO: 282508 - DNA, 5548 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282509 - DNA, 5418 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282510 - DNA, 5815 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctaaaaaaaa

SEQ ID NO: 282511 - DNA, 3564 bp, Homo sapiens
aattggaagtggagttgtcttggttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282512 - DNA, 2540 bp, Homo sapiens
tgagcggttctctgacttggaaaaacctgcggtagcgtatctatttagcgctcgagattatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgtttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgtt

SEQ ID NO: 282513 - DNA, 3393 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttggtgctcatttccctcatagccccattacggagaaaactgtcttaaggtactggcactgcaagctgtattttaatagaatcattgaaaaaaagaagtaaatctagggtcatccagttcag

SEQ ID NO: 282514 - DNA, 428 bp, Homo sapiens
gagcactcccggtgaccacctagtctccattttatttcctcggaaactgccgggcaggcgggggaccggccgcagggcggggtttctcttggcgaattgtttcctgccagcggcagccgagctgcgttcacgcgctgatcggagaatgagtgacagtcccagcctcagcacactcgcaactcggagatccttgcgctggcccggagagacatacaacacccttcagcagatcccctgggaaggaggtgggaagagacttaagttagaagaaaactccgatgtttggaagagatttccagaaataacccgaagaaaatgttttcctgtttataaattctgaaatctgtggtctctttattaaaatagccaggcttttatataggtattatgatatagaagcgtcattaaataatattttcttacatggg

SEQ ID NO: 282515 - DNA, 1599 bp, Homo sapiens
agatgcggtggtggccgccgagcgcctggaaggagctgctggacaggccgagggagcctccgcccgagaccgcgcagccgccgccgccatggctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggtatgattttcataagttatttcacatattgggttttttatatagctctttacaaatcattataagatccatctatttacagtgtggttttattttgttgttttcccccctgtgacttcttcatttcattttcacttccattacaagctttacaaagcagattatggaaaatcacttaggagaaggaggttttattaatagtatgaagtgggacctttggttatacctgtagttactgagacccattttaatagtggttttttggaataaaagagatgaaagcttattattcacaagtttgcaaatactggggaggctgaggcaggagaatcgcttgaacccgggaagcagaggttgcagtgagccgagatcgcaccactgcactccaacctgggtgacagagcaagactccatctcaaaaacaaagaaacactgaacagttatcctatctgatctttttatatgcaggatagtgattaaatcactctacaaccactttcctctaatttctcctcataagcctaatcaaatgtatttgccttacttcctaccattctgttgaagattctccgaaaattggagaaagcactaaatatggtaggaagattctcttgaagttcctgtgatcttttgaaactgcattcctgagttctatccttacttccttaaagcagcatgcacttttggtttgttgttaatcaggggtctcctgtgcttggtgtgtggggtaggaaggcaggtgatcacctgcaacaattcttcacagattggaagttaaacatgaaaagcccccggagaccccacgaactagatgccagaaagttctgcagtcattgactgttaactgcaattccaactatacggtcagccctccatatccatgggttccatatccgtggattcaaccaacatggattgaaatattcc

SEQ ID NO: 282516 - DNA, 969 bp, Homo sapiens
acattccttcagtcattataaagttcttaaaatacaaaagaaattaaatctgtaagaaagtctagtagaccagatgctgttgtcaagacttgtatgttggtgtttttgctttcagtacatcccacgccatccacctccactcatgccgccttgcccatagtaacctccactgcctccaccaccacggccataaccacccaaaccatcaggagtaccatatcctccactgtaattgttccccattcccattcttccaactgatccatagcctccctgattatctttaaaaagaaaaaagaaaaaaaattgagactcatcgataagcagctaaccctgcatattttaaaaactttacatacccattccatctcttccgtagcctcccattccagaacctcccatgccagagccgcctccaggagtagaattcaagaagagttcaatatatcgatgttctttaagaaaaaaagaaagagtaacaggggagaaaggaatgatggataaaattcatcaatacaagctttgtaaaaaagatcaattaagtaatattaaacaaagtatgcttattaattactagtacagcgatatataaagcccacagaaagccattatagaggtcaaatggttttaaatcccaacaactgccaagcgttacctacagatcttagagcctcttattttataaattcacgtttaggaaataagattgtgtgccaaagacaccacttacgcatgttatttttatctttagacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttgatttttcctcatcaattaaaacaaacccttccactg

SEQ ID NO: 282517 - DNA, 642 bp, Homo sapiens
tcgtgatccgcgggcctcggcctcccaaagtgctgggattacaggcatgagccaccgcacccagccgaaaatgccaatatttcttaaaaagcaagttttaaatctaaaatatttttgctttaggacatttagaaaatataggaaaatatgaaatattccactagccagagaaggccataaaaatcatatactatacataattttatatcctatgaaataccaatacctactgaaatactaagtgttctatatttaaatatgtgtactgaaatttggacctatttgtaatctttttagatcaaaacttaaaattgaagacataaaagaagccaacaaagcattgcagggactggtttggctgaaagacaaagaagcaacacattgtaaactttgtgaaaaggaattctcactctctaagagaaagacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttgatttttcctcatcaattaaaacaaacccttccactg

SEQ ID NO: 282518 - DNA, 4344 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagttctagcctcagttttacccaaagttgatttgaattacaccagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcactaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgacttacttgcttttttttttttttttttaaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttaacataccattccctcacctagcagtactaccacaataatgctatcatggtgccagggaattacaattgtaattcttctaacctataatgtttaaaaaataaaatgtgaattttatgaactaaataaatatttggaaaattagcctgctttaaaagggcaattttggtttcattaatactgtatacttttactgctttaagatgttaagagagtaatcctgggaaaataaaacacatacaactttcaaaaaagacaggtggtgtatgccctaatatttaaattgctcattaaaggaagtggatacaagcattaagatgaatcatagcttcagtcaag

SEQ ID NO: 282519 - DNA, 3349 bp, Homo sapiens
  misc_feature (8)..(8): n is a, c, g, or t
tttgaacntagatagcctgtctccagcctgggcgacagagtgagactgtctcaaaaaaaaaaaaaaaatgactaatagcactgctttatatcacacacacacaaacacacacacacaaatcaaaaccaccatagcttttgtttttataaatagggttctgaagatggcttgaaagaaaaaaatgaaataattgcccgactagaagaaaaaaccaataaaattactgcagccatgaggcagctggaacaaagttctagcctcagttttacccaaagttgatttgaattacaccagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcactaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgacttacttgcttttttttttttttttttaaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttaacataccattccctcacctagcagtactaccacaataatgctatcatggtgccagggaattacaattgtaattcttctaacctataatgtttaaaaaataaaatgtgaattttatgaactaaataaatatttggaaaattagcctgctttaaaagggcaattttggtttcattaatactgtatacttttactgctttaagatgttaagagagtaatcctgggaaaataaaacacatacaactttcaaaaaagacaggtggtgtatgccctaatatttaaattgctcattaaaggaagtggatacaagcattaagatgaatcatagcttcagtcaag

SEQ ID NO: 282520 - DNA, 3007 bp, Homo sapiens
tcgtgatccgcgggcctcggcctcccaaagtgctgggattacaggcatgagccaccgcacccagccgaaaatgccaatatttcttaaaaagcaagttttaaatctaaaatatttttgctttaggacatttagaaaatataggaaaatatgaaatattccactagccagagaaggccataaaaatcatatactatacataattttatatcctatgaaataccaatacctactgaaatactaagtgttctatatttaaatatgtgtactgaaatttggacctatttgtaatctttttagatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcactaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgacttacttgcttttttttttttttttttaaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttaacataccattccctcacctagcagtactaccacaataatgctatcatggtgccagggaattacaattgtaattcttctaacctataatgtttaaaaaataaaatgtgaattttatgaactaaataaatatttggaaaattagcctgctttaaaagggcaattttggtttcattaatactgtatacttttactgctttaagatgttaagagagtaatcctgggaaaataaaacacatacaactttcaaaaaagacaggtggtgtatgccctaatatttaaattgctcattaaaggaagtggatacaagcattaagatgaatcatagcttcagtcaag

SEQ ID NO: 282521 - DNA, 2017 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccaacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttgatttttcctcatcaattaaaacaaacccttccactg

SEQ ID NO: 282522 - DNA, 1653 bp, Homo sapiens
tcgtgatccgcgggcctcggcctcccaaagtgctgggattacaggcatgagccaccgcacccagccgaaaatgccaatatttcttaaaaagcaagttttaaatctaaaatatttttgctttaggacatttagaaaatataggaaaatatgaaatattccactagccagagaaggccataaaaatcatatactatacataattttatatcctatgaaataccaatacctactgaaatactaagtgttctatatttaaatatgtgtactgaaatttggacctatttgtaatctttttagatcaaaacttaaaattgaagacataaaagaagccaacaaagcattgcaggtgagtagaacgttttcctaaagtgggaaggtatgtgaaagtctccaatggaaggtaatgccctgtgtgaatctaatgtattattaaccccaggatatatagaggccgaagcactgaatgaggagcttggatgctgggggttcagctcttccctgtacccctagagtcacattattaataaccttcctttagaaactgaccttagaggccgggcgcagtggctcacgcccgtaatccgagctctttgggaggccgaggcaggtgggtcatttgaggtcaggagtttgaaaccagcctggccagcatggtgaaatcccatctctactaaaaatacaaacatttgttgagtgtggtagtgggtgcctgtaatcccagccactcgggaggctgaggcaggagaattgcttgagcccggaaggtggaggttgcagtgagccgagatcgcgccactgcactctagcctgggcgacagagcaagactctgtctcaaaaaagaaaacaaaacaaaaaacggtacaacaaaagacaccagcacaaaatggtatagtcatcaccattctatgctgatcagtctttcattatactcttaactggacttcacgaatgtagctttttacttgtttgaatcctatgtaggttgacacacaatggatacaaaaatatccatcagtgattagaattaaaggtagatctaattagccaggcgtggtggcgggcacctatagttccagctactcgggaggctgaggcaggacaatggcgtgaacctgggaggcagagcttgcagtgagccgagatcacaccactgcactcagcctgggggacagagcaagactccatctcaaaaaaagaattaaaggtagatctatttttatattcaagggattttggtattaagctataaacatgagaacattaagaatgcttaaagatttagacaccaggataagtataaaaccactaatagttattaaaaattactcacattagcaatgtcattttcagttgcacgaaaaggcaaccctctcatatgtacgaaatgaccaccatgaaaacctgaacttgcatcaccagctccaccatagccatgtcctcccatacctggaaaacacaatttgccaagattataaactattacagatacaagtagggaagtatacatacatactatacaaggtataaagctctatataggaatgcactgaaatttgtctgaattaactttatacaagtttcctatattaccactaagagcttgcaaagcaaatactaaaatttacctatgaataaaaatgtctttaatattt

SEQ ID NO: 282523 - DNA, 1936 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttgatttttcctcatcaattaaaacaaacccttccactg

SEQ ID NO: 282524 - DNA, 216 bp, Homo sapiens
caaacatataagcattctcgtcaggggctagatgaaatgtacaatgaagccagaaggcagcttcgagatgaatctcagttacgacaggtaggttatattaaaaattacattagcaagatcatcctgggagtaatttaccctcaagcaagcaccatttaaaatctttttcagccttatcctttttggtgtggtatgtagcaagctcaccccttaatc

SEQ ID NO: 282525 - DNA, 429 bp, Homo sapiens
tgggcgacagagtgagactgtctcaaaaaaaaaaaaaaaatgactaatagcactgctttatatcacacaattattttaatgtataaagtaactctgttcatttcaaagtaacagtcccatagcaaaatggtgtaagaaacttataaatactcaggttaacagatcagaactctacttgggaggctgagaggtgggatagcttgagcccagaagttcaaatccaacctgggctgcatagtgataccctatctattaaaaacacgcacacacacacacacacaaacacacacacacaaatcaaaaccaccatagcttttgtttttataaatagggttctgaagatggcttgaaagaaaaaaatgaaataattgcccgactagaagaaaaaaccaataaaattactgcagccatgaggcagctggaacaaag

SEQ ID NO: 282526 - DNA, 2146 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaagacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttgatttttcctcatcaattaaaacaaacccttccactg

SEQ ID NO: 282527 - DNA, 4301 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcactaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgacttacttgcttttttttttttttttttaaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttaacataccattccctcacctagcagtactaccacaataatgctatcatggtgccagggaattacaattgtaattcttctaacctataatgtttaaaaaataaaatgtgaattttatgaactaaataaatatttggaaaattagcctgctttaaaagggcaattttggtttcattaatactgtatacttttactgctttaagatgttaagagagtaatcctgggaaaataaaacacatacaactttcaaaaaagacaggtggtgtatgccctaatatttaaattgctcattaaaggaagtggatacaagcattaagatgaatcatagcttcagtcaag

SEQ ID NO: 282528 - DNA, 4039 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctcttggtctctttaaaaatcagttattgtcgtgcttgctgaagattttcagctacagtggattaaattaaagggggcattatttggcctcggcctctacttttttccttttaatcttgaaaggaagttacatataaccatctttcttttcctgatttataaatcttcccatatgctgtttcactaaattgctgtttttttaaggggtgactcagaccccaattcaaagatgaaaacacaaatccttccccagaaaaaaaagtatgtaatagtaggggatgttacaggctccttataaaggtcctctcctctaagcattaaaagtgagaaaaaaatcaggactttgctttggtaatgtattagagttcagttcaaaaaattttgtattaacattttcattggagtaaattttaggaagtatcacattgtagtggcctacctgtatacatccacagtaaaatttcaccatgtccattgagcacctctatgccaagggtgttgagatgatgaaatatacacttgacctatttctttttttttcgagatggagtttcactcttgttgcctaggctggagtgcaatggcacgatctccacctcctgggttcaagcaattctcctgcctcagcctcccaagtagctgggattacaggcgtgagccacagcacctggccagtacacttgacctatttcaagctgactcaatgaacactaatccaagttatattgcttatggcatactaagaatttaacttgtataaattacctctgaatagttacataaacactatcaccattcagtatcctattttttacattaatttttaaccatgcactttaagtttgtgagcctataaaaaatacatagaaaatttatggattaagagcattatatttagtggttaatcctaggtacctccctgcctacaaaggagttcttattaatactgcaggatcttttcttcatgaatatatgcttccatgaaatttaaatttttctgaatagcctaagtatgaaatgaatattttacttgaagatctattttttccaaaacccgtaaatttccagtcagcttttgaggtgtcagatgtgacacagatttctagatggtctttcttgaatactgacagaaatgtcctcaagagaggattatattcttgaaccattttgtattgataggtgggatgggctaacatttttatgattactgaataaacaaaaaatgaaattttcaaatatgcttttttattactgtgcttagaacaaattttaaaatgtgacttaagttgcttaaattccaaggctaatttcattcaacaaaccatgattttgtcatcctttaagtaagtttctcacttttcaaaactcatgtatcaacactgacttacttgcttttttttttttttttttaaggcagcttttatgacagcaacttgctccatgtagttttggcttatttaaaaactatactaactttggatttttctgttacaagacttttaacaatctgtatttcgtgattgtgaactcgtattcattttacttttcaaaaacagacttacaattgtaattccctggcaccatgatagcattattgtggtagtactgctaggcgggggaatggtatgttaagtc

SEQ ID NO: 282529 - DNA, 2947 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgaatcaaaacttaaaattgaagacataaaagaagccaacaaagcattgcaggtgagtagaacgttttcctaaagtgggaaggtatgtgaaagtctccaatggaaggtaatgccctgtgtgaatctaatgtattattaaccccaggatatatagaggccgaagcactgaatgaggagcttggatgctgggggttcagctcttccctgtacccctagagtcacattattaataaccttcctttagaaactgaccttagaggccgggcgcagtggctcacgcccgtaatccgagctctttgggaggccgaggcaggtgggtcatttgaggtcaggagtttgaaaccagcctggccagcatggtgaaatcccatctctactaaaaatacaaacatttgttgagtgtggtagtgggtgcctgtaatcccagccactcgggaggctgaggcaggagaattgcttgagcccggaaggtggaggttgcagtgagccgagatcgcgccactgcactctagcctgggcgacagagcaagactctgtctcaaaaaagaaaacaaaacaaaaaacggtacaacaaaagacaccagcacaaaatggtatagtcatcaccattctatgctgatcagtctttcattatactcttaactggacttcacgaatgtagctttttacttgtttgaatcctatgtaggttgacacacaatggatacaaaaatatccatcagtgattagaattaaaggtagatctaattagccaggcgtggtggcgggcacctatagttccagctactcgggaggctgaggcaggacaatggcgtgaacctgggaggcagagcttgcagtgagccgagatcacaccactgcactcagcctgggggacagagcaagactccatctcaaaaaaagaattaaaggtagatctatttttatattcaagggattttggtattaagctataaacatgagaacattaagaatgcttaaagatttagacaccaggataagtataaaaccactaatagttattaaaaattactcacattagcaatgtcattttcagttgcacgaaaaggcaaccctctcatatgtacgaaatgaccaccatgaaaacctgaacttgcatcaccagctccaccatagccatgtcctcccatacctggaaaacacaatttgccaagattataaactattacagatacaagtagggaagtatacatacatactatacaaggtataaagctctatataggaatgcactgaaatttgtctgaattaactttatacaagtttcctatattaccactaagagcttgcaaagcaaatactaaaatttacctatgaataaaaatgtctttaatattt

SEQ ID NO: 282530 - DNA, 1703 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaacctccaggatgaaaatcagcagttgaaaaaaatatatcatgaacaagagcaagctcttcaagaactcggcaacaagcttagcgagtaatttcttttttccttcaactaagtagtcattattgacttttataaaagattaaggatagagaggttaaggatagagggattaaggatagagagataagccatagagagc

SEQ ID NO: 282531 - DNA, 1535 bp, Homo sapiens
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatataagcattctcgtcaggggctagatgaaatgtacaatgaagccagaaggcagcttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaaggtacagcatttccagtcttagtttctttttttcttttcttcttccctttttctttattcagttcctacacctgccacaaaaaccattaggaagacatagattaggacatgttttttgtttaagcccagcaggattttgcgtttttgctttggttgttgcatggaatcaagttgctttatattacgctgattcatttgaagttgtcatattgtagatttttcttagaggcctaatatcagcagtttcatgtcgttcagttacataaaacaaatacacaaataaaaatgtc

SEQ ID NO: 282532 - DNA, 331 bp, Homo sapiens
ctgaccccgcggtaagagccgggctgggcgcgggccgcgggggcgggagggccgggcagggtggagggcgagggccccccggggctcctgccctcgcagacgggcacccacgcggcctcccgcgcgccctcttggcaccagggctgtgccgaggtcaccgagtggactcgcagcggccggagcggagtcggggcggcgtgggggccaaggcacagctgggcgcggaggcggcgcgggcttttccctgggctagcgtgcgccgcggcgccttcaccagggcgggaaccgccgcctcctctagggctgctcgggctgccacccgcgcgcaccg

SEQ ID NO: 282533 - DNA, 956 bp, Homo sapiens
gcacgagacatagagtacatagaagagtgagctctgaaagaactctcacatggaccccagaaagaggagtactcaacgcctgctgcacagaaggcatcagcagttaagtactggctagaaaagcagagtccatcaaaggagaggaccacagtggtagctgcctgttacaagctattgaggcactccagagtgacggcatgtgatccccctgacacaagaaacaggcccagataacacaccgttcagaccgacagcagttctggttatgctgcagtacatcagaaaagtgctcttatccatccacagttcttatcacagttacttatgcatatattcattttttatataaaagaatcttgaatcggtcacttaaatattgaatctcaataataaaaaatactaaaagtatagctaaatgtgttattttattttgcatttgtcctacactcttcccctcacttttttaggacatgtaatcaagacatttgggaggttgttcaataccagaatgacagagcaccatcgaccatgctcagaccgtactaaccccttgacaattatcacagtctttcttggatggggactacagagtcctggaggaccaatgacatattttggggggtatgataattctctacaataacttttaaattttgtattttcactgcaataaactaaaacataaccaatattagtaatagtctgcatggtctgatgaccactttatgaccaatgacattttgacttatgatcacaatctaattaatgccaagaagtacaactttaattgtctcaagaatggacaaaacactgaagtatatgtgatatgagaattatgcttctctaagagataaagactaatttacattatgcaaaaaagaagagataggccggacacggcagctcacgcctgtaatcccagcactttgggagaccgaggcaggcagatcacctga

SEQ ID NO: 282534 - DNA, 960 bp, Homo sapiens
cttttcagaaagacaggcaacgtgttggaccttccgcagcttctcagaagacagagggttttcttttgaggctgttgtacagtggcctgattatagctcactgtagccttgaaattctgggcccaaatgatcctcctgcctcagcctccaaagtagctgggactacagttacaagctattgaggcactccagagtgacggcatgtgatccccctgacacaagaaacaggcccagataacacaccgttcagaccgacagcagttctggttatgctgcagtacatcagaaaagtgctcttatccatccacagttcttatcacagttacttatgcatatattcattttttatataaaagaatcttgaatcggtcacttaaatattgaatctcaataataaaaaatactaaaagtatagctaaatgtgttattttattttgcatttgtcctacactcttcccctcacttttttaggacatgtaatcaagacatttgggaggttgttcaataccagaatgacagagcaccatcgaccatgctcagaccgtactaaccccttgacaattatcacagtctttcttggatggggactacagagtcctggaggaccaatgacatattttggggggtatgataattctctacaataacttttaaattttgtattttcactgcaataaactaaaacataaccaatattagtaatagtctgcatggtctgatgaccactttatgaccaatgacattttgacttatgatcacaatctaattaatgccaagaagtacaactttaattgtctcaagaatggacaaaacactgaagtatatgtgatatgagaattatgcttctctaagagataaagactaatttacattatgcaaaaaagaagagataggccggacacggcagctcacgcctgtaatcccagcactttgggagaccgaggcaggcagatcacctga

SEQ ID NO: 282535 - DNA, 449 bp, Homo sapiens
ccgggagtggtggcacatgcctgtaatcccagctactcgggaagctgaggcaggagatttgcttgaacccaggaggtagaggttgcaatgagctgagattgtgccactgcactccagcctgggcaacagagcaagactctgcctctaaataaataaacaggtaagtaaactactctttctataccttctctttctagttacaagctattgaggcactccagagtgacggcatgtgatccccctgacacaagaaacaggcccagataacacaccgttcagaccgacagcagttctggttatgctgcagtacatcagaaaagtgctcttatccatccacagttcttatcacagttacttatgcatatattcattttttatataaaagaatcttgaatcggtcacttaaatattgaatctcaataataaaaaatactaaaagtatagctaaa

SEQ ID NO: 282536 - DNA, 4714 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282537 - DNA, 4204 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282538 - DNA, 601 bp, Homo sapiens
cccccgccccctctttttgttaaagactgggtgtgtaatcaactacttattttcttgcagacggtgtgttaatctaattattttctttgtccacactgaggttccctcctacagaggaaggtgattttctcgatcccccccattttttattggagacgcgccccgcactatatttttgagaatctctgtgtgtataagaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282539 - DNA, 3811 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggt

SEQ ID NO: 282540 - DNA, 4481 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgaggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggt

SEQ ID NO: 282541 - DNA, 4819 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagtttcagggagtttctggaacgctttaaaaacctcaagttaagaacccttaatcgccgtggcttcagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282542 - DNA, 2299 bp, Homo sapiens
ctgccttgaaagagctatctagttgggagtacagatacataaagtaagatactgtgtgtgatctgggagcacacatgagagagcaactgactctgcccacagttggggaagacttcacatttgaacaggatcttgaaggatgaatagttagtaaaggaaagaagggatgagagatgggctttcaaacagcagtaaaagaacatgcagaaacagagcctgaggagcaaagggtagtaaaagtggagtggtgacaagccttgtacagatgtctgagcagtgggttggagcctgctggaggtccagtgtcctgtgtccttcctccagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282543 - DNA, 4256 bp, Homo sapiens
  misc_feature (4044)..(4044): n is a, c, g, or t
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagtttcagggagtttctggaacgctttaaaaacctcaagttaagaacccttaatcgccgtggcttcaggtacatgcagataactatatatttgcctgtttctcacctagaacttaacaaacactacacagcagcccttttgcaatataattgggactaatagttaatacttcaaccgcatacacagattcatgtcctaatcttgatgtatagccaaggcctttcatttgagcctaagtctactgcattattaatgatttacaggttcaattgtttaaagtggaataagaatttcaatctattggtataacaatatatgagtgtaaaatccttctagatttatctgatttcccctccctacagtctttttattgctgatcttacaactaattccacagcagtgttttaatgactcatctttattgaatcaaagtgaagtgcttagcattcagctaaagaaaagatcatagcccactggggagattaggaaaggcttcacagaagtggcatttgagctacgccatgaagataagttcctaagtatatctcagaggcaataccttaggcaacaaaattatctgtccaagtgacctccatggtatttcccctccagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagagacaagaagatcttgcactcttgcccaggctggagtgcagtggtgcgatcacagttcactgcatcctcgaactcctgggctcaagggattctcctgcctcagcatcccgagtagctgggactacaggcatgcaccaccacacctggctaattttttaaattaatttttttgtaaagaccagggctcaccatcttgcccgggctggtcttgaactccagggttcaagcaatcctcctgcctcagcctcccaaaatgttggtattacatatgtgagccactgtgcctggcctccgttaaattttctaattggttgttgctgattaaaaagacggctaatgatcttttatgttgattcttgattaactaaaattatttctgatagtttttcaccagcttctcttaagagtttctaaaaatacaaatagctgttaataacagtttggtttcctcctttctcatatgtatttatttatttacttttttttttttttttttgagacaaggtctcactctgttgcccagggctgggagtgcagtgggcatgattgtggctcactgcagccttgacctccccaggctcaagcaatcctcccacctcagccttctgagtagctgggactacaggtgcccgccaccatgcccaactactttgtanttttttgtagagatgggttttcgccatgttggccaggctggtctcgaactcctggcctcaagtaatctgcctgcctcagcctcccacagtgttgggattacaggcgtgagccaccgcacctgggctcctttcccatatttatacccttaaatttttttctggccttactgcatagctagatctctaagacaataaatattagctatgataac

SEQ ID NO: 282544 - DNA, 1853 bp, Homo sapiens
  misc_feature (1613)..(1613): n is a, c, g, or t
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcggtgagaccttctcccacacccccaagcagaagcagatcctcctgctggttctgactcctgctcctccccacagtcttcgccgtgatggcgaaggactgtggcacagggatttgcgctgctgagatatttattacagcgcctgggacaaatgacaacttagtgtttttcacacctgtgacacgtgactcacctatatcctgctgtggagacgtgaagacaccatgatgacctatagaagcagaagacagggnattagagtcaaacagaagcaatgaaatgtacatttttcaacttgtttagagtgatatggcccagtgtgaacatgacgacaggatttggagagggagcgatatgttggcagaaaaggctgaccggcgggagttcattgacctgttgaagaagatgctgaccattgatgctgacaagagaatcactccaatcgaaagcctgaaccatccctttgtcagcatgacacacttactcgattttcc

SEQ ID NO: 282545 - DNA, 358 bp, Homo sapiens
tggatggagtgtgcctgaagcccccggggtctccataatcgccccctttcctcctccccagcgggtccttccgggtggcccggactgcatggtggggagtggggccgagtccgctgatccagctcacgctccctccccctcgcagggccggccaaggagtgcgaaaaggaccaattccagtgccggaacgagcgctgcatcccctctgtgtggagatgcgacgaggacgatgactgcttagaccacagcgacgaggacgactgccgtgagtggcgggccagggagctcagacccggggagagaaaaggaacggtggggggcaccatgcttggcgcgcacgtggctgcagccgccgcgc

SEQ ID NO: 282546 - DNA, 3925 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282547 - DNA, 4639 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggt

SEQ ID NO: 282548 - DNA, 5363 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagtttcagggagtttctggaacgctttaaaaacctcaagttaagaacccttaatcgccgtggcttcaggtacatgcagataactatatatttgcctgtttctcacctagaacttaacaaacactacacagcagcccttttgcaatataattgggactaatagttaatacttcaaccgcatacacagattcatgtcctaatcttgatgtatagccaaggcctttcatttgagcctaagtctactgcattattaatgatttacaggttcaattgtttaaagtggaataagaatttcaatctattggtataacaatatatgagtgtaaaatccttctagatttatctgatttcccctccctacagtctttttattgctgatcttacaactaattccacagcagtgttttaatgactcatctttattgaatcaaagtgaagtgcttagcattcagctaaagaaaagatcatagcccactggggagattaggaaaggcttcacagaagtggcatttgagctacgccatgaagataagttcctaagtatatctcagaggcaataccttaggcaacaaaattatctgtccaagtgacctccatggtatttcccctccagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282549 - DNA, 4212 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagtttcagggagtttctggaacgctttaaaaacctcaagttaagaacccttaatcgccgtggcttcaggtacatgcagataactatatatttgcctgtttctcacctagaacttaacaaacactacacagcagcccttttgcaatataattgggactaatagttaatacttcaaccgcatacacagattcatgtcctaatcttgatgtatagccaaggcctttcatttgagcctaagtctactgcattattaatgatttacaggttcaattgtttaaagtggaataagaatttcaatctattggtataacaatatatgagtgtaaaatccttctagatttatctgatttcccctccctacagtctttttattgctgatcttacaactaattccacagcagtgttttaatgactcatctttattgaatcaaagtgaagtgcttagcattcagctaaagaaaagatcatagcccactggggagattaggaaaggcttcacagaagtggcatttgagctacgccatgaagataagttcctaagtatatctcagaggcaataccttaggcaacaaaattatctgtccaagtgacctccatggtatttcccctccagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcct

SEQ ID NO: 282550 - DNA, 2284 bp, Homo sapiens
gctggcggcggccgcccagggccggggccgcgcgcccagcctgagcccgccccgccgccgagcgtcaccgaacctgcttgaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagcccgggcccgccatgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcgctgacaacggcctcactgacacgccttactacacgcctcactacacgcctaa

SEQ ID NO: 282551 - DNA, 593 bp, Homo sapiens
agtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagtaagtatttctcactgggagaattcctaccttccgaccatcttcccttccatcctttcttcccctcccatcctttcttccttcccatcctttcttccctcccttccttccttccgtccttccctccctcctttccttccgtccttccctccctccctgtcttttttctttccttctttccttcctttcctccctccttcccttcctccttctttccttcctcaaacatttatcaaaaacgcaccatgtatcaggcactgttctaggccctggggaacacagaaatgctggggtaggtggttaaggtaaaaaggtatcaggaccaccttgtacctagaggctcttcctggcagtaaaaaaagccaaatgtctctctttctgctcagtaaattttcagaacctttagcctggaagggta

SEQ ID NO: 282552 - DNA, 323 bp, Homo sapiens
agacacacctgtgttcctttggcacagacattctggagtcccagtgcccaggaaagaagacgggaggcagtagcagagcctgggagagatggcctgaggatgttgtgatggaagactgtatatgatcatatgcactgctgtccagaaatattccttcctgctggactcagagaaccccaggacctctacccaacgtgcctgctccaaagaaggaatgaggttctgcagagctgtggtccgagccgtgatcaggaaggatgcctcgggaagtatagttttccccagcaaactgcccagcagtgcatccgccggctgtggctggc

SEQ ID NO: 282553 - DNA, 960 bp, Homo sapiens
gaaagtctcttgatgttttatatggtactcttattaataatcccagagagcaggggttggcaaactatggcccatgggctaaaatggtttttacattttaaaagggttgaaaactttaaaactggaaggatacatgacagagactggatggcctacaatgcctaacatattatctagccctttacagaaaacaactgaccaatccttatgagaccagacttgcaaaaattacagtaacagagtgaaaaaccttcttgaagtgttaggaggaacttgagtcataatttgatgttgaatcagagagaacaactgtttgggcttatttgcctcagagtatttgcccagcctctgttaacatcgtgacctccagttccatccatgttgctgcaaatgagatgggattttgctatgttggccatgctggtcttaaactcttggcctcaagtgatccgcccacctcagcctcccaaagtgctgggattacagggtttccactgagaagtctgctgaaagctgtattggatgtgggattcagaatgtgttgctggacttcaagataggaagaatctttgccttgatggctgatgacagtaaccaccccatctaccatcatctattaaggatttactgtgtggtcactttacagtcatccaagtaaattttcataatcacctgattacatgggtaccgcttttcagaaaaagaaacagatttctggagggattcagaatccatggctggaagaggtagtaaggccattgggagggcatgcctctcctcagcccacccccaccctgtgtgggtctccattctgaaatttccattcagatgacccggtcctaggcagggaccaaaattccttgtcagctgaggaagtcctgaagaaacatcctgaagatgatgactgcactgccatcgtgggcagatgcagcttccatctacctgagggctgaaggggaa

SEQ ID NO: 282554 - DNA, 446 bp, Homo sapiens
gaaagtctcttgatgttttatatggtactcttattaataatcccagagagcaggggttggcaaactatggcccatgggctaaaatggtttttacattttaaaagggttgaaaactttaaaactggaaggatacatgacagagactggatggcctacaatgcctaacatattatctagccctttacagaaaacaactgaccaatccttatgagaccagacttgcaaaaattacagtaacagagtgaaaaaccttcttgaagtgttaggaggaacttgagtcataatttgatgttgaatcagagagaacaactgtttgggcttatttgcctcagaggtaagaaaatcaagttttaactaagattaacccacagaagtagatattaatactaaggtttcgacctaataataactaacctgtattaattgtgtgcagtgtaccagaccca

SEQ ID NO: 282555 - DNA, 978 bp, Homo sapiens
gaaagtctcttgatgttttatatggtactcttattaataatcccagagagcaggggttggcaaactatggcccatgggctaaaatggtttttacattttaaaagggttgaaaactttaaaactggaaggatacatgacagagactggatggcctacaatgcctaacatattatctagccctttacagaaaacaactgaccaatccttatgagaccagacttgcaaaaattacagtaacagagtgaaaaaccttcttgaagtgttaggaggaacttgagtcataatttgatgttgaatcagagagaacaactgtttgggcttatttgcctcagagtatttgcccagcctctggtaactatcattctattctctacctccatgagagcaactttcttagctcccacatgtgaatgagaacatgcaatatttgtctttctgtgcctggcttatttcagttaacatcgtgacctccagttccatccatgttgctgcaaatgagatgggattttgctatgttggccatgctggtcttaaactcttggcctcaagtgatccgcccacctcagcctcccaaagtgctgggattacagggtttccactgagaagtctgctgaaagctgtattggatgtgggattcagaatgtgttgctggacttcaagataggaagaatctttgccttgatggctgatgacagtaaccaccccatctaccatcatctattaaggatttactgtgtggtcactttacagtcatccaagtaaattttcataatcacctgattacatgggtaccgcttttcagaaaaagaaacagatttctggagggtaagtaacccaaatcgtacagctgagccatctgtctgcatctcaagcattgaggcagcattcggcctccgagggtgttgtcaaatgtgctggtctctgttaactcagggttttggattaatgggtggagctgctcattttcacaaacaccca

SEQ ID NO: 282556 - DNA, 1848 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282557 - DNA, 1051 bp, Homo sapiens
  misc_feature (21)..(21): n is a, c, g, or t
  misc_feature (808)..(808): n is a, c, g, or t
  misc_feature (818)..(818): n is a, c, g, or t
taggctaagtacgaggccggngggtgagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccaaaacgcagggggtggtgcccccggtcctggccgaatcgagtctcaatctcgcacccaggttccgggcctntccgtgaccnggggagtcacgtcgagccgggcgtcatgccggtgctgcatggccggagggacgggggcatcccgggggggtccccagccccggtggaggcggtcctcccacggcggggaaggcggcggttggtccccggttgctggcggcacccgcctacgggggggttcccccaccaaacctccggtgggagtgacgcggcgcccttcgtgtcttttgtgctcagattcgtcgtctgctgcg

SEQ ID NO: 282558 - DNA, 849 bp, Homo sapiens
  misc_feature (22)..(23): n is a, c, g, or t
  misc_feature (25)..(25): n is a, c, g, or t
taggctaggtacgaggctgggnntntatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccc

SEQ ID NO: 282559 - DNA, 801 bp, Homo sapiens
cgcacatcttttagaggcataatacagtacagaacaccaacgaacgatccggaagtctaatcactgtgaacaaacacagcttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacacaaggccgacccggggccaagatcttcccaaggctgagggcccgctccctttcaacaacggccgccccggcgaaagttaaccgaacggccttattgggggctccaccagaaccaaaggtttccgctagacaaggtggcgccc

SEQ ID NO: 282560 - DNA, 2343 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcaaaaaaaaaaaaaaaaaaaaaaaaaaaaaaaaaaaaaaaaaaaaaaaaaaaccacaggaaaacatacaagaaagaagaaagacaacaaaccagaaaaacaaaaaaggggggggcgccgaacataaaatagaacccgctgggagggccagcgatataagtgacccgcgcaccatgttaccattcacaaacagagggccccccaccgtaggaagcgaggtaactataataaacacgacgcaggcccgcggcgcggcgacttataaaccacgaccggccgcagcggacaaaacgagcgactgcagctggcacgtcccatcgacggcagggggaaccacccaactaggcggggggcacacatacgaggcgggagcaacccccaccacgcagaatgagagacccggcagcataagaaaagaaacgcgaggcggtagcagcgcagcacagcgacaatacgcgcggagaacaagcgaccgaggatagaaacaaacaatgccgc

SEQ ID NO: 282561 - DNA, 1391 bp, Homo sapiens
  misc_feature (1223)..(1223): n is a, c, g, or t
  misc_feature (1390)..(1390): n is a, c, g, or t
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacacggggagatcagtcgaagtcgtgagccgatccatgcaggtggtgatgcccgggggnaggggatctcctgggtgtgtcccggagccctggtggtggggtctcctcccacggcggggagatgggcgctgttggcccgggtccatgggctcacccggccagcgggggttttccccggaaaactgccggagataggcggggcctgtggtgtgttcttccacctcccng

SEQ ID NO: 282562 - DNA, 1527 bp, Homo sapiens
  misc_feature (47)..(47): n is a, c, g, or t
acaacccacaaaccaccccaccattcatgatgagtcgcggtttaatnggccgaggggcagcgtacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282563 - DNA, 1676 bp, Homo sapiens
caaggtagctggtgggaatcggacgagagttggtgagcatcatggcaaccgttccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagtacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282564 - DNA, 2219 bp, Homo sapiens
tccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtacctgttcagtgtgtctgagagcgcgagggcgcctagtgagcctttagtgggaagaaattgtcgaggaacaagagagtcttagtggagaggactgaaggattagggacccagaaatcgggatcttgtcatgctaccgttttggccattttcatatttccagtatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagtacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282565 - DNA, 1775 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282566 - DNA, 1487 bp, Homo sapiens
tattcatttggcaaacctgttttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282567 - DNA, 1527 bp, Homo sapiens
ccagtaaggccgcggtttattcggccgaggactctggcagttggtgagcatcatggcaacgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282568 - DNA, 1772 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282569 - DNA, 1815 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtcctcatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282570 - DNA, 1420 bp, Homo sapiens
ctctggcagtggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282571 - DNA, 1553 bp, Homo sapiens
  misc_feature (1)..(1): n is a, c, g, or t
  misc_feature (23)..(24): n is a, c, g, or t
naagcctagggctaggtacgagnnctgggtgttagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccggtgggaattccaacccccaaattccgggaatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282572 - DNA, 1498 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatccgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282573 - DNA, 544 bp, Homo sapiens
tcgctattcattcggcactcgctattcatcggcacctcagtacgaatacagaccgtgaaagcggggcctcacgatccttcgctattcatcggcacctcgctattcatcggcacccctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282574 - DNA, 1079 bp, Homo sapiens
tccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtacctgttcagtgtgtctgagagcgcgagggcgcctagtgagcctttagtgggaagaaattgtcgaggaacaagagagtcttagtggagaggactgaaggattagggacccagaaatcgggatcttgtcatgctaccgttttggccattttcatatttccagtatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaagtacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggccgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282575 - DNA, 605 bp, Homo sapiens
caagagagtcttagtggagaggactgaaggattagggacccagaaatcgggatcttgtcatgctaccgttttggccattttcatatttccagtatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaaggtaatgtgacctgaacttagggactgggctgggcttacaggtgcctcaatttccatgatgagcccagtcaagatggaggaaggg

SEQ ID NO: 282576 - DNA, 1587 bp, Homo sapiens
caaggtagctggtgggaatcggacgagagttggtgagcatcatggcaaccgtttacagccacaaccaaagtcccggagatccgtgatgtaacaaggattgagcgaatcggtgcccactcccacatccggggactggggctggacgatgccttggagcctcggagcttcctgatgtggtagaaatgccatggtagccccacaggaaatcacctcatgtgcgcctcccacccacaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282577 - DNA, 1070 bp, Homo sapiens
  misc_feature (902)..(902): n is a, c, g, or t
  misc_feature (1069)..(1069): n is a, c, g, or t
ccagtaaggccgcggtttattcggccgaggactctggcagttggtgagcatcatggcaacgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacacggggagatcagtcgaagtcgtgagccgatccatgcaggtggtgatgcccgggggnaggggatctcctgggtgtgtcccggagccctggtggtggggtctcctcccacggcggggagatgggcgctgttggcccgggtccatgggctcacccggccagcgggggttttccccggaaaactgccggagataggcggggcctgtggtgtgttcttccacctcccng

SEQ ID NO: 282578 - DNA, 1907 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgcacccaccctgtgtatgtgtggttgccctgagcccacagaaagacacctccagagtgcgga

SEQ ID NO: 282579 - DNA, 1664 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacaatgtgcacatgtaccctaaaacttaaagtataata

SEQ ID NO: 282580 - DNA, 1828 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttgtacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282581 - DNA, 1495 bp, Homo sapiens
cctggtggcgaattcggcacgaggcagttgtacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282582 - DNA, 1502 bp, Homo sapiens
  misc_feature (22)..(23): n is a, c, g, or t
  misc_feature (25)..(25): n is a, c, g, or t
taggctaggtacgaggctgggnntntatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282583 - DNA, 1523 bp, Homo sapiens
  misc_feature (1)..(1): n is a, c, g, or t
  misc_feature (23)..(24): n is a, c, g, or t
naagcctagggctaggtacgagnnctgggtgttagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282584 - DNA, 1518 bp, Homo sapiens
caaggtagctggtgggaatcggacgagagttggtgagcatcatggcaaccgtttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282585 - DNA, 1383 bp, Homo sapiens
  misc_feature (1140)..(1140): n is a, c, g, or t
  misc_feature (1150)..(1150): n is a, c, g, or t
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccaaaacgcagggggtggtgcccccggtcctggccgaatcgagtctcaatctcgcacccaggttccgggcctntccgtgaccnggggagtcacgtcgagccgggcgtcatgccggtgctgcatggccggagggacgggggcatcccgggggggtccccagccccggtggaggcggtcctcccacggcggggaaggcggcggttggtccccggttgctggcggcacccgcctacgggggggttcccccaccaaacctccggtgggagtgacgcggcgcccttcgtgtcttttgtgctcagattcgtcgtctgctgcg

SEQ ID NO: 282586 - DNA, 1440 bp, Homo sapiens
ctctggcagtggtgagcatcatggcaaccgtgtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282587 - DNA, 1107 bp, Homo sapiens
gtcgttgtgcggaatctgtgcggaattcgtcgtcgtggtgcggaattcgtcgtggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282588 - DNA, 866 bp, Homo sapiens
catgcccttccctgccctgtctccgccgttcttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282589 - DNA, 1231 bp, Homo sapiens
tggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgca

SEQ ID NO: 282590 - DNA, 325 bp, Homo sapiens
gggggatgggcgagcttgggcccattcctttccttaccctaccccccatccccctgtagggacgtgatcaccatcgacaaggcgacgggcaagatctccaagctgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccctcagcctggcac

SEQ ID NO: 282591 - DNA, 1139 bp, Homo sapiens
gcggccgcccagtgcgccgccgtccagccgcgcgcgtcctccgcctccgctgccgcgggtcccgggcccggagcctccagcaggcgcgcggccagcagcgtgtggcccagggcagcggcccagtgcagcggcgtgaggcccgtcccggagcgagccgccgccgaggccccgcgctgcagcagcagctcggccacccgcgagtgtccgtgccaggcggcctcgtgcagcgcggtgcgccccgcccggtccaccgcgcccaccggggcccctcgctgcagcaggagacgcaccaggggcgcgtggccccgcagcacggccagaaggaaagctccgtaaggctgaccgggaaagaagcgaggagctctgggggctgggtggaaagtcccgtactcatcagggccagggaggccacagaaactacctcacgccagcttcccaggggtacagcggctagaatggacctcgaggaggcccctcccaagactcccgtctcccgggttccaccgcagtgggggcagccacagctgcctctgcaatgcttgtaggacccacacacagtggggcacggaggggcagaggccgcagcccctttgccatgaatccaaagaacctggagtgattctgcagagacgttcgaaccagagcgactccatcttgaacaggggctgggtaaaatgaggccgagaccggctgggccgcattccctggaggtcaggcattcttagtcacaggatgagatcagcacaagatacagatcacaaagaccccgctgataaaacaggatgccgtgaagaagccggccccaaaccaccaaaaccaagacagccagtcctcactgctcattatgtgctgattataatacattagcatgagacacgcccaccagcaccaggaccatttacagttgccatggcaatgccgggaagttaccctagatggtctaaaagggggaagaaccctcacttccgggaattgcctgcccctttcccggaaaagtccggaataatccacaccatgtttagtacatatcaagaaacaacaataagtgttctcgtcggagtagcccaggccgctgctcagcctatggggcagcccttttcttattcctttactttcctattaaacttgctttcagttta

SEQ ID NO: 282592 - DNA, 372 bp, Homo sapiens
tgctgggattacaggtgtgagccactgtgccaggccagagtttgtcttttaaaaagatttctcatatatgtaaaagcatttccaaggctgctgattgcatgtctttttattttttttaattccctacttccatttcacagcatattatactcccctttaagtactatatggtatatatgtctttttccacattgaatcacttggagggatttttgtatgtgtgtgtgatgtttttgtgtttgagacctctgtgatgtctttatttatgtctgaggtaaaaccaccattgagtttggccatgttataaaccagagaataaaaggatgaactaatcatttactttatttactaacaggtgttcaatatgaatgc

SEQ ID NO: 282593 - DNA, 332 bp, Homo sapiens
tgttcatttctgtctcaagtcagcttctctgagaatccaatttataaaaatatatttgtgaatgtataagtaaagtgacttggattttgtctacgtacaaggacttctatgcctgcataaaacagcgtagtttggaaccagcagcagcagcagctccccagacctactgaatcagaatctacattttgataagagcccagggtgactccatgtacgtgaaaaagtttgagaagtccttagacctacagttcacagcttctccttctttcttattcaactgaattgcagtgggacctgagtatggttaaaataaatgaataaaaacacaaatc

SEQ ID NO: 282594 - DNA, 1232 bp, Homo sapiens
ggcggcgctgcgcttcctcctggcgcgcggggcgcgggtggacgcccgggatggcgcgggggccacagcgctgggtctggcggccgccctaggccgctcccaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctaca

SEQ ID NO: 282595 - DNA, 1493 bp, Homo sapiens
tgttgctgaatccggcacgacggaagcgcagacactccaccccaaagcctgcagaagggattttgtgaagagggtcaccaggctgagcctcggccagaacccgtctacagaggaccctcagccagagcagaaagctcctgagccagctcccttggatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctaca

SEQ ID NO: 282596 - DNA, 1153 bp, Homo sapiens
gcgacacgccctatgccacacaaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctaca

SEQ ID NO: 282597 - DNA, 1269 bp, Homo sapiens
cagaacctcaccctgccctcctccccagcctggaatcgggaggaggggccggcacccacccctgggtgggcttagccagctgggacaggagtgggtgagggggctgcccgagggtgggccccatggagagccctgtgaggccttccaggggcacatcggggtacatccaaggctgcgcttcctgggggaggtggcgtctgagcaactttcgtccacaagcatgttcctgcttgtcctccccaaccgcctggcctttgttccccaggagggcagccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttgggtaacagagccaagcccctctgaaggctaagtggtaactggaatggggggctccagttggcctgggacacggctgggggcaggccagaggcctccacagtggatgtaggatccctgctcccccccagatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagagggaccacgcaggccggaccccgctccacctggccgtgctgcggggccacgcgcccctggtgcgtctcctgctgcagcgaggggccccggtgggcgcggtggaccgggcggggcgcaccgcgctgcacgaggccgcctggcacggacactcgcgggtggccgagctgctgctgcagcgcggggcctcggcggcggctcgctccgggacgggcctcacgccgctgcactgggccgctgccctgggccacacgctgctggccgcgcgcctgctggaggctccgggcccgggacccgcggcagcggaggcggaggacgcgcgcggctggacggcggcgcactgggcggccgc

SEQ ID NO: 282598 - DNA, 525 bp, Homo sapiens
gcggccgccctaggccgctcccaggtacgtcccgccctccgcccggcagtgatgggagggggcgcagggccaggatccccagagacgtgccaccggggcagctggagccaggctgggggacggtgtccaggcacgaaggccctgagcgcgcccccggctgtgcccctccggtgtagccccgtcccgtggagaccagggcgggatccgaggcccggggctcggcttcatgctggtggcagcaacagactctccgccagcgccgggcctgtgcctgagacccccgttcctgggcagcgggcagggtgttggctgcagatccttggatttgctctaaggactcttagggggaaaagtggacgtttccaagcaggccagccttgggttcggcctcacaacatgaggaagtggtgtcaggagagacaggccgctgcggggacagaagaggcctgggctgggcaaacgcctggtggctctgcccctcgcctaccgggctgaggccggcccctgcttttctctcctcttcta

SEQ ID NO: 282599 - DNA, 2050 bp, Homo sapiens
cagaacctcaccctgccctcctccccagcctggaatcgggaggaggggccggcacccacccctgggtgggcttagccagctgggacaggagtgggtgagggggctgcccgagggtgggccccatggagagccctgtgaggccttccaggggcacatcggggtacatccaaggctgcgcttcctgggggaggtggcgtctgagcaactttcgtccacaagcatgttcctgcttgtcctccccaaccgcctggcctttgttccccaggagggcagccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttgggtaacagagccaagcccctctgaaggctaagtggtaactggaatggggggctccagttggcctgggacacggctgggggcaggccagaggcctccacagtggatgtaggatccctgctcccccccagatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctaca

SEQ ID NO: 282600 - DNA, 1923 bp, Homo sapiens
cagaacctcaccctgccctcctccccagcctggaatcgggaggaggggccggcacccacccctgggtgggcttagccagctgggacaggagtgggtgagggggctgcccgagggtgggccccatggagagccctgtgaggccttccaggggcacatcggggtacatccaaggctgcgcttcctgggggaggtggcgtctgagcaactttcgtccacaagcatgttcctgcttgtcctccccaaccgcctggcctttgttccccaggagggcagccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttggatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctaca

SEQ ID NO: 282601 - DNA, 854 bp, Homo sapiens
cagaacctcaccctgccctcctccccagcctggaatcgggaggaggggccggcacccacccctgggtgggcttagccagctgggacaggagtgggtgagggggctgcccgagggtgggccccatggagagccctgtgaggccttccaggggcacatcggggtacatccaaggctgcgcttcctgggggaggtggcgtctgagcaactttcgtccacaagcatgttcctgcttgtcctccccaaccgcctggcctttgttccccaggagggcagccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttggatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagagaaggtagagctgttcttaaatttattaaaaaaaaataaaagggaatctcagtgtctgtta

SEQ ID NO: 282602 - DNA, 233 bp, Homo sapiens
agaagaacaggctgggcagggggaggcaggcagacactgatgcatgtgtatgtgcggtgtgtgtcattcatctcagcagcccccagagcccctcacggagatgtggagaacatctgccatcaaggcccttaatgctacaggacaagcaaacctcagcctggaggcacttttccagattttgtcggtggttccagtttataacaacctcacaatttatactacggtaatgagcg

SEQ ID NO: 282603 - DNA, 5073 bp, Homo sapiens
  misc_feature (3621)..(3621): n is a, c, g, or t
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282604 - DNA, 5150 bp, Homo sapiens
  misc_feature (3698)..(3698): n is a, c, g, or t
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282605 - DNA, 4982 bp, Homo sapiens
  misc_feature (3530)..(3530): n is a, c, g, or t
ctcacgccctaaggatgtagccccgctcgcagtgcacacgcagtcgcacgccgccgacctctgagcgggtcagacgcccttgtgctttttgtttctagggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282606 - DNA, 4833 bp, Homo sapiens
  misc_feature (3381)..(3381): n is a, c, g, or t
tcgacccacgcgtccgcgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaatgaaagcaggccaggtgcggtggctcacgcctgtaatcccagccctttgggaatgtcttacgcaagctgacagtggatgtgcaattcttaaagaatgggcagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282607 - DNA, 1834 bp, Homo sapiens
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagcctcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282608 - DNA, 4773 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
  misc_feature (4202)..(4202): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattcaccttacagggggatcctcgtcagatgtc

SEQ ID NO: 282609 - DNA, 1716 bp, Homo sapiens
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282610 - DNA, 2509 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctc

SEQ ID NO: 282611 - DNA, 1240 bp, Homo sapiens
ggatcccctggctagtgaatgatgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaacctcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282612 - DNA, 1881 bp, Homo sapiens
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaacctcacaatttatactacggtaatgagcgccggtagcccagacaagtacatgactaggatcagaaacccgagtagaaagtaagtcagcagaagagcgagttcgcccgtgctgtgaaagtgagcaagaagaacccatcaggtgattgtcaggcctctgagcccaagctaagccatcatatgccctgtgacctgcacgtatacatccagatggcctgaagcaactgaagatccacaaaagaagagaaaatagccagttcctgccttaactgatgacatttcaccattgtgatttgttcctgccccaccctaactgatcaattgactttgtgacaagacaccctccccacccttgcaataatgtactttgtgatattcccccgcccttgtgaatgtactttgtacgatacaccctccccacccttgagaaggtactttgtaatatcctctccgcccttgagaatgtactttgtaagatccacttcctgcctgcaaaaaattgctccgaactccaccgtctatcccaaacctataagaactaatgataatcctaccaccctttgctgactccttttttggactcagcccacgtgcacccaggtgattaaaaagctttattgctcacatgaagcctatttggtggtctcttcacacagatgtgtgtgacagtgataacagtgtcacgtggtttaactacaatgtgtccagatattgaattttgtttaagcctgcttgggatttgttgtgctccccaaatttcaagtttgtgtcttttgttcaattttggaaaatagtcagctatctcagaattgctcacctaaaaaaa

SEQ ID NO: 282613 - DNA, 1042 bp, Homo sapiens
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggtcccgagtcaagtctgattacgatcacggagttggtggcaggtcaaccaacaggatcggacaatatcgtccatcaagagcccctgaggctacatggacacagcggtccgcatgccgggatgaccacttttccagatgtt

SEQ ID NO: 282614 - DNA, 5654 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
  misc_feature (4202)..(4202): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282615 - DNA, 5753 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
  misc_feature (4202)..(4202): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaacctatggccctgcttctttctcaatagctactttcttactgctttgtgaaaataatatgcaaccattttattacttaattatgtgacattaagaaataatttggttgcatattattttc

SEQ ID NO: 282616 - DNA, 5125 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
  misc_feature (4202)..(4202): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282617 - DNA, 5241 bp, Homo sapiens
  misc_feature (3789)..(3789): n is a, c, g, or t
ctcacgccctaaggatgtagccccgctcgcagtgcacacgcagtcgcacgccgccgacctctgagcgggtcagacgcccttgtgctttttgtttctagggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttgagtgccccaagcccgcgcggagtaacgcggggcttgcgggggcccccgacacagactagcgggaggagacatattttccgtgtgataaaaacagggcggtgcctgcttgcctagaaacctccagcgcttcctctttgcctctctgggtaaatctgagctgcacatcgtaggcttcgagagggaaagcagattctccgattcaacactaaactttccctctacgtgtagccccgggttttctcttccccaatccaggttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaaggtttgttgttactgttttgtggagagggggtgaggtgggtgtgtgctggtatttcttacagagggtggtaacatccttaaaatgtatacatatataatattttctgacaagcatctggcattgtcatttgtgtcagattgtcatcattagatattttatttggaattgtttgtatgaaaaccaatcttcggcggggcgtgatggctcatgactgtaatttcagcactttgagaggcagaggcaggcagatcacttgaggtcaggagttcaagaccagcctggccaacatggtgaaaccccatctctactaaaactacaaaaaaactgttagccaggtgtggtggtgggtacccaaaatcccgactactcaggagctgaggtaggagaatcacttgaactcgggaggtggagtttgtagtgagctgagatcacaccactgcactccagcctgggaaacagagtgagactccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282618 - DNA, 1863 bp, Homo sapiens
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaacctcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282619 - DNA, 5143 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
  misc_feature (4202)..(4202): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatatnctggcataaagggccttgtcccagatctcaagtgttagggaagcacttggtcattttcttccctttctggcatattagagaaaatgatgtgtacataaaatttcctcataattttcagcctcacaatttatactacggtaatgagcgccggtagcccagacaagtacatgactaggatcagaaacccgagtagaaagtaagtcagcagaagagcgagttcgcccgtgctgtgaaagtgagcaagaagaacccatcaggtgattgtcaggcctctgagcccaagctaagccatcatatgccctgtgacctgcacgtatacatccagatggcctgaagcaactgaagatccacaaaagaagagaaaatagccagttcctgccttaactgatgacatttcaccattgtgatttgttcctgccccaccctaactgatcaattgactttgtgacaagacaccctccccacccttgcaataatgtactttgtgatattcccccgcccttgtgaatgtactttgtacgatacaccctccccacccttgagaaggtactttgtaatatcctctccgcccttgagaatgtactttgtaagatccacttcctgcctgcaaaaaattgctccgaactccaccgtctatcccaaacctataagaactaatgataatcctaccaccctttgctgactccttttttggactcagcccacgtgcacccaggtgattaaaaagctttattgctcacatgaagcctatttggtggtctcttcacacagatgtgtgtgacagtgataacagtgtcacgtggtttaactacaatgtgtccagatattgaattttgtttaagcctgcttgggatttgttgtgctccccaaatttcaagtttgtgtcttttgttcaattttggaaaatagtcagctatctcagaattgctcacctaaaaaaa

SEQ ID NO: 282620 - DNA, 3060 bp, Homo sapiens
  misc_feature (389)..(389): n is a, c, g, or t
  misc_feature (399)..(400): n is a, c, g, or t
  misc_feature (410)..(410): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (463)..(463): n is a, c, g, or t
  misc_feature (466)..(466): n is a, c, g, or t
  misc_feature (487)..(489): n is a, c, g, or t
  misc_feature (492)..(492): n is a, c, g, or t
  misc_feature (497)..(497): n is a, c, g, or t
  misc_feature (520)..(521): n is a, c, g, or t
  misc_feature (523)..(524): n is a, c, g, or t
  misc_feature (530)..(532): n is a, c, g, or t
  misc_feature (541)..(541): n is a, c, g, or t
aaatcagtattctgctactcaaacaaatgagctatttggataacaaagcatacccagtggtctgctagtaaaccagctctttgtgtgggaagggacaaatgaaaaaattcccaaattcgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcngtggctcacnnctgtaatccnagnactttggangcngaggcnggtggatcacntnaggtcagganttcgagacnagnctggccaacatggtgaaaccnnntcnctacnaaaaatacaaaaattagccaggnntnntggtgnnngcctgtaanttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctga

SEQ ID NO: 282621 - DNA, 1734 bp, Homo sapiens
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgagcaagaagaacccatcaggtgattgtcaggcctctgagcccaagctaagccatcatatgccctgtgacctgcacgtatacatccagatggcctgaagcaactgaagatccacaaaagaagagaaaatagccagttcctgccttaactgatgacatttcaccattgtgatttgttcctgccccaccctaactgatcaattgactttgtgacaagacaccctccccacccttgcaataatgtactttgtgatattcccccgcccttgtgaatgtactttgtacgatacaccctccccacccttgagaaggtactttgtaatatcctctccgcccttgagaatgtactttgtaagatccacttcctgcctgcaaaaaattgctccgaactccaccgtctatcccaaacctataagaactaatgataatcctaccaccctttgctgactccttttttggactcagcccacgtgcacccaggtgattaaaaagctttattgctcacatgaagcctatttggtggtctcttcacacagatgtgtgtgacagtgataacagtgtcacgtggtttaactacaatgtgtccagatattgaattttgtttaagcctgcttgggatttgttgtgctccccaaatttcaagtttgtgtcttttgttcaattttggaaaatagtcagctatctcagaattgctcacctaaaaaaa

SEQ ID NO: 282622 - DNA, 981 bp, Homo sapiens
agctgattcctagagtatcacatggaccatcatcgctgaatggagcgtggttccgagttgagacaaattacgaccactggaagccagcacccaaggaagatgaccggagaacatctgccatcaaggcccttaatgctacaggacaagcaaacctcagcctggaggcacttttccagcctcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttaaagt

SEQ ID NO: 282623 - DNA, 1234 bp, Homo sapiens
  misc_feature (942)..(942): n is a, c, g, or t
  misc_feature (973)..(973): n is a, c, g, or t
ttacccgggctacgagcagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcacctctggtcttgcaaggttgttcttggaaacgctttttacanatgtgaaaagggagacaggtggagtcagtgnttccaaacttgaccatagatcagaatcacctgtagggcttcacaaaatacagattgctgagttctgcctccagagtttctgatttagtaggtctggagtagggcctgagaatttgagtatctgagttcccagataatgatgatgctctggatctgggaccacactgtgggattcattggtttaagaacctaaactgaagtctcatagcgggtaacccgaagaccttggcttaaacaggcatttatctacattacctttgca

SEQ ID NO: 282624 - DNA, 732 bp, Homo sapiens
acaagatgatgtgctctgttgtaggtggttccgagttgagacaaattacgaccactggaagccagcacccaaggaagatgaccggaggtaggctgctacgtgctttctggtttgcagtgttttcttatggtcaggagaatatgcccattctgtcacaggaactggcaagacctatgggtgctatcctctcccagaaaatgtacctgagccccttcgccagtgccttggctgggaagggagtgttgtgtggaggagagcagtgggcagagcctctcagcagctgggcgggtgttgggaggctgtcagggtcaggagccctagagcccaccaccagctctgctagtgactcactgggtggctctcgggcctctgtttaccagtctgtaaaatgaaagcaaagggccaggttcatggtcttctaggcaagatatttttagaaggaaattatttcccttatttaaacaataaataaaccagtcaagggtttttattgtcccttcaagttgtaaacattctataattataagtcagcacagttccaaagtgcaggtagctatatacgttgccttggctttactaccccacaagtttggccactgttcagttctgcagccacacattttcatcatcccagctttctggagcagatggtgccaaccgtcccagctgctggatgaattccactgtggtgggctgggcctcagcaggaaacaggcttggggccagaatctg

SEQ ID NO: 282625 - DNA, 194 bp, Homo sapiens
tacatggggggctgggatctaccccaggggctgagtaaagaaaccaggccactgtgtaatgcttctgcatctgatcaccttagaccccgacccaaaaccccaaaccactctccatcctccccagactcgcagactgctgacttctctaagccatctttctgattttctcctctgctcaaccccatgtgccgctc

SEQ ID NO: 282626 - DNA, 210 bp, Homo sapiens
aaaagaaagagctttaatgtttggaatagattctgcatcaaaagaagcaacttatcatcttgccaaacctcagcctcgtcattgttttggagcaagaaagagaattgaacctcactcatgttttgttgcctgtaccattgaacaaggccctgactgttaagactaatgttgagacccttgttttctttgcagactgcatcatctgctatt

SEQ ID NO: 282627 - DNA, 353 bp, Homo sapiens
caaaaaattggagtcaccccacgggcatgttcccaggcactgggacaactcttttccaaagaaagacccaaaaatcgtacaaataagtccaaatgaagcatgatgggaaatcagggactaattctgcttggaggacagggaaggctttcaaagctcttacaatgaaacatggcaataaacaaaatctcatttactgttggaaagatctgggagcaatgttagaagaaaagttaacaaaaaggtaaaaggattttaggagccaatataactactaataatgaaaatacctgtgagaaaattattcccaactagatgactacctattacaaataaatatttttctctaacctatt

SEQ ID NO: 282628 - DNA, 326 bp, Homo sapiens
gtgaggctggaacatgagaaatccactgtgaattgtgagatgtgagacaagcgcttgtgtggggctagattgtgactggctttatatgccattataaatattagttggtggttgaggggaccttggaagctctggctctttcagagttaacttgtaccataaccacagaatttgtattagttctatacaattcatgctgaattgagagactccacatttccattaaagtatgcctaatagtagacagtaataaatgcttgtctttaactgataaaggtcacaccgatttctctaattttttggaaatctccattttatcataaata

SEQ ID NO: 282629 - DNA, 931 bp, Homo sapiens
caggagccagagatagagggacggagaccaagactcggagtagttcatgaagagagagaagaggggaacaaggcgaggcttaaaaggaaaagggaaaacaggaagcgaccattcccagagacggacagacagacaaacccaaggagggtgaagtcaactgtcttcccggcctgttgggagccctcccctcactttgaactgggccaaaggagtccagcccacaaggcgtctgaggaagggatgtctctgcccaactggagaatctcctcaagggctcagctgcgaaacacctgtcactcaaccaggagatttactccaaatttcaagtccagctttttagaaagtagaagactgtctactccccaggtatggagcccaggccctgaggcaggacgatgagaaaaccaaggcactgaaagctggaaaggggcagaccagacgcaaacactgctttcttgactccactcactacaagctgcttccttaagcctaaacttggctcttgcctcacaggactatcttgcaggaacctagcaacccaccttgccccatcctgaggcagaggaggcagagatcacagacagcattctctccattacctacagacggagaattaaagcgcagagaagctgcgagggacaattgtggtgatcatgacaagacagccctcgggatctgaatccacatccaccttgatgggttgagaggactagaaaccagagaacacccccatctctaatgccgcaagaggcccctgatgcaggatcttgcaggaataagaaggctccatggaacgggacgaggcaggagcagagaggagccatgatacgttaactctcccagtcaccccactgatcaaaaccttaagacttgaggattctggttccttgtgctgggggtctccatctatccccactcaagcacaagaacc

SEQ ID NO: 282630 - DNA, 902 bp, Homo sapiens
caggagccagagatagagggacggagaccaagactcggagtagttcatgaagagagagaagaggggaacaaggcgaggcttaaaaggaaaagggaaaacaggaagcgaccattcccagagacggacagacagacaaacccaaggagggtgaagtcaactgtcttcccggcctgttgggagccctcccctcactttgaactgggccaaaggagtccagcccacaaggcgtctgaggaagggatgtctctgcccaactggagaatctcctcaagggctcagctgcgaaacacctgtcactcaaccaggagatttactccaaatttcaagtccagctttttagaaagtagaagactgtctactccccagatgagaaaaccaaggcactgaaagctggaaaggggcagaccagacgcaaacactgctttcttgactccactcactacaagctgcttccttaagcctaaacttggctcttgcctcacaggactatcttgcaggaacctagcaacccaccttgccccatcctgaggcagaggaggcagagatcacagacagcattctctccattacctacagacggagaattaaagcgcagagaagctgcgagggacaattgtggtgatcatgacaagacagccctcgggatctgaatccacatccaccttgatgggttgagaggactagaaaccagagaacacccccatctctaatgccgcaagaggcccctgatgcaggatcttgcaggaataagaaggctccatggaacgggacgaggcaggagcagagaggagccatgatacgttaactctcccagtcaccccactgatcaaaaccttaagacttgaggattctggttccttgtgctgggggtctccatctatccccactcaagcacaagaacc

SEQ ID NO: 282631 - DNA, 1763 bp, Homo sapiens
cccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagccccctgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagccgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgctacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtaaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgactggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtcaccttctggggcacggtctttggggagaggggagtgcatttagacttatgtggaactgtacaaattgtgatgtggctacatagaaagccatgtgctaagaataaactccatttaaaaaacattaaaaatctaagattcatgtgttttctaagcttttcattaagaaa

SEQ ID NO: 282632 - DNA, 1172 bp, Homo sapiens
caaggcgttctgggggcgcacgctggttcagggaacactctggctttgggattctgcaatcggagagactacctgtagtcctgaggcctgtaggcctggctgctctgaggaggattggctatggcaaagaaggacggctttggctccaggagagggctgtgaagggcagaggccgcacctgtgtgctttgggctctggtctgggctagcgagctggctggaccgaggtggccttcaaggtcccacacctacatactcccagaccaccctccaggctggcagaggtggagctgttcaatgggcagcccagggcaagggcagacagtggggcccagctcgccgtcctgccccccttggagagaaactgaaagcttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacacccag

SEQ ID NO: 282633 - DNA, 1543 bp, Homo sapiens
tacaactttgcaatacaactttatgagttgttcggcccttccattggccgctgtcggtcatgtggatgagaaccgtgaacatgaacttttttataatttcccttgcgagaatagagccgcattcttttgctccgctccgtcctgcctgcttcggagctctgccttccagccgggctcggctgtgctttgtccggagatggcgagcgaagggaagccccggccaggccaggcctggcggctcccgctggagattgggcgcgctccgttcccggcgccgcggcagcagctttgcaactcgcaacctggctaatttcctgcgtcctctggcaccaggaaagaggacaattcttctctcgggctgcccaagcgacagctgtcagaggggcaggagcttctgggagccaccgtgctacgtgtgccgcctggccattcaaactgtcaattttaggtccagaagtgtccaaaccacaagttctcaaaactctctgaaaaatggctccctccgagttaaggtcttggagctggagaaggagttccacttcaatcgctacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtaaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgactggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtcaccttctggggcacggtctttggggagaggggagtgcatttagacttatgtggaactgtacaaattgtgatgtggctacatagaaagccatgtgctaagaataaactccatttaaaaaacattaaaaatctaagattcatgtgttttctaagcttttcattaagaaa

SEQ ID NO: 282634 - DNA, 1317 bp, Homo sapiens
tacaactttgcaatacaactttatgagttgttcggcccttccattggccgctgtcggtcatgtggatgagaaccgtgaacatgaacttttttataatttcccttgcgagaatagagccgcattcttttgctccgctccgtcctgcctgcttcggagctctgccttccagccgggctcggctgtgctttgtccggagatggcgagcgaagggaagccccggccaggccaggcctggcggctcccgctggagattgggcgcgctccgttcccggcgccgcggcagcagctttgcaactcgcaacctggctaatttcctgcgtcctctggcaccaggaaagaggacaattcttctctcgggctgcccaagcgacagctgtcagaggggcaggagcttctgggagccaccgttaattcagccagagttctccgctcgttgccggcttcccttcgcccggtttttcgatgagagaggtgtctgaagcgctgggagggggaataggtgcgtgggtggaattcttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacacccag

SEQ ID NO: 282635 - DNA, 1704 bp, Homo sapiens
cccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagccccctgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagccgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgctacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtaaaaagaataatcaaaaagaagacattatccggttaagagtctgtgctggttgccacccaagagagaacagttgtccaggatgctggctggtggaacaacctgctggcccgaaacaaggctgccaggtgtggatacagcccatgctgactggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtcaccttctggggcacggtctttggggagaggggagtgcatttagacttatgtggaactgtacaaattgtgatgtggctacatagaaagccatgtgctaagaataaactccatttaaaaaacattaaaaatctaagattcatgtgttttctaagcttttcattaagaaa

SEQ ID NO: 282636 - DNA, 973 bp, Homo sapiens
atgagttcctattttgtgaatcccactttccccgggagccttcccagcggccaggactccttcttgggccagctgcccctctaccaggctggctatgacgcgctgaggcccttcccggcctcgtacggggcgtcgagtctcccggacaagacgtacacctcaccttgtttccttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacacccag

SEQ ID NO: 282637 - DNA, 2309 bp, Homo sapiens
cccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagccccctgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagccgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccggtacgtggcgccgcttgggaggcgcgggaggtgggccggggctgggcctgggttcgagggtcggggtcaggagggagaggctcaggggaagggggcctcgggaggggagcccccatctggcccgggctgcggtgagatgtgggtatgtgcgcgccagccagccgcctgatcccaacatgagaacccttttgtacccagggtccctttatcaggagatttacgagacgccaaactgttagggcagtaattatagcccccataaatttaattgccctggcagaggcttcaggccatgtgtctttgaagcttttcttcagccccaatgcccagcaccattctttatggctctcgggtgtttcccgttgtcaatagcctgtgaaacattttctttgccgttttatgtatcttgcgtgaacttggtgtcaggttattatataatgatgatgtccaattgctcttccccaccccaccttctctctcctcctcctttccctctcttccgctccctcctccttggccttctatttcggggttctgggttttcagttaaccccagttataacggaggggagcctaagcgctctcgaaccgcctacacccggcagcaggtcttggagctggagaaggagttccacttcaatcgctacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtaaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgactggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtcaccttctggggcacggtctttggggagaggggagtgcatttagacttatgtggaactgtacaaattgtgatgtggctacatagaaagccatgtgctaagaataaactccatttaaaaaacattaaaaatctaagattcatgtgttttctaagcttttcattaagaaa

SEQ ID NO: 282638 - DNA, 1001 bp, Homo sapiens
  misc_feature (894)..(894): n is a, c, g, or t
  misc_feature (902)..(902): n is a, c, g, or t
  misc_feature (908)..(909): n is a, c, g, or t
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaagggagnccgaagcnggcaanngagccatggaacgagtcgggcaaagtggcacgaaggataaacggaaaaagggatcgacaacacgcggaaaacagggccaagagacaactagg

SEQ ID NO: 282639 - DNA, 445 bp, Homo sapiens
ccttactttaatcaaatgtataagaagtaaatatgaatattatatggcagaagcaggaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282640 - DNA, 513 bp, Homo sapiens
gtcacgccggtaatcccagcactttgggaggccgaggcgagtggatcacctgaggtcaggagtttgagaccagcttggccaacatggtgaaaccctgtctgtagaaaaatgtcagggctcagcccagaaattgctgcaggtgaggctgtgtacttggagtagggaaaaaaggtatgttatagtgctattaaaggagaatggtaaggaagcatgggaagataaagtaatgtttcttttagatgtacatcagtgccatcaggctggccttcactaatttatagggtacctttatgtcaattagaaaaataaacttctgagggaacacagcttggccaaatgaaaccacgggataacatttaccactgtttgcctccttggcccatgtgcagagaaccctggttgttgactctctcctgggattgggctatccatgatagccctatcccaggagaaggaaaacgatacgaagcagacggatgaggaagtgttccatctcctgtaatggctagcagg

SEQ ID NO: 282641 - DNA, 3552 bp, Homo sapiens
gagttaacttcctgacccaggaagtggcagcaacagaggggactagcagcgaatatgtaagtgtctgagcagtgaaggttacggaaaaggtccaggctaaggttttctcagtggatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282642 - DNA, 2868 bp, Homo sapiens
gtgactatactgtaaggctgagtgtatagcatgattgctttaccactgtgtgatacctgctaccaccatcttagtggcagtggcccagtctcagggctgtgcacagattcaccactaaggacctttatgataagtgttctctaatctgggctcactgtgaaggaaatccgatcaccaaaagctagtccttacagagggagcatggacaaagctcctggccctcagacttcagcaaggatgagaatagatgcaaatgttgataaacatcctgccatgctgaatctcccagaagctggtaggaattattccatctgggtatccatcaatacctaagactggtgggaattactttgtttgagtatccatcaatatctaagactaagactagggtaactctctttacttcttcgggtaaagcaaagaagaatagccctgcatgacaagccccatgaaataccgatgttcccatgctcaccttttctttttgtttctttatagaatgtgaatgacactttgagcaggtaagtcctgtttgaatgcaggaggggaggggtgtgcgtatatagaaatgaatggaatgcacctctgaagaaatctctcgcctctgcttattctaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282643 - DNA, 2655 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgaaatagacaataaactggccaggcacagtggctcatgcctgtactcccagcactttggaaagccgaggcgggcagatcacctgaggtcaggagttaaagaccagcatggccaacacggtgaaaccccatctctactaaaaatacaaaaattagttgggagtggtgatgagcgttactgctg

SEQ ID NO: 282644 - DNA, 2312 bp, Homo sapiens
  misc_feature (2275)..(2275): n is a, c, g, or t
  misc_feature (2282)..(2282): n is a, c, g, or t
  misc_feature (2286)..(2287): n is a, c, g, or t
  misc_feature (2312)..(2312): n is a, c, g, or t
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaagngtagcgntggnnattaagagagtcgttcacgctaagn

SEQ ID NO: 282645 - DNA, 1319 bp, Homo sapiens
gtgactatactgtaaggctgagtgtatagcatgattgctttaccactgtgtgatacctgctaccaccatcttagtggcagtggcccagtctcagggctgtgcacagattcaccactaaggacctttatgataagtgttctctaatctgggctcactgtgaaggaaatccgatcaccaaaagctagtccttacagagggagcatggacaaagctcctggccctcagacttcagcaaggatgagaatagatgcaaatgttgataaacatcctgccatgctgaatctcccagaagctggtaggaattattccatctgggtatccatcaatacctaagactggtgggaattactttgtttgagtatccatcaatatctaagactaagactagggtaactctctttacttcttcgggtaaagcaaagaagaatagccctgcatgacaagccccatgaaataccgatgttcccatgctcaccttttctttttgtttctttatagaatgtgaatgacactttgagcaggtaagtcctgtttgaatgcaggaggggaggggtgtgcgtatatagaaatgaatggaatgcacctctgaagaaatctctcgcctctgcttattctaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggca

SEQ ID NO: 282646 - DNA, 3490 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282647 - DNA, 3394 bp, Homo sapiens
gagttaacttcctgacccaggaagtggcagcaacagaggggactagcagcgaatatgtaagtgtctgagcagtgaaggttacggaaaaggtccaggctaaggttttctcagtggatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccgagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282648 - DNA, 3444 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282649 - DNA, 3586 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggtaagtcctgtttgaatgcaggaggggaggggtgtgcgtatatagaaatgaatggaatgcacctctgaagaaatctctcgcctctgcttattctaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtcttttttttaaaaaaaaa

SEQ ID NO: 282650 - DNA, 2590 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctga

SEQ ID NO: 282651 - DNA, 1941 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggca

SEQ ID NO: 282652 - DNA, 1698 bp, Homo sapiens
gagttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaaggtatgttcactaaagaattcctgaatactgtggatagaaggggccttatgcagtaaccaagtttaccacctgtcccttggcaggctcacagccagagaggttgtttagttaatttcagtagagctttcatactttctctagttagtatgattcactgctcagtgaatgtgatgagcattgcattctggttatctgtgcaaacctttcaaattcttattctttcacttattagccatgttactccaagtgacttggtttccccctctgaaaaatgaaaatattaacagctcctacttcattgagttatcatcaaaattaaatgcatcaacatgtacaaagtgcttag

SEQ ID NO: 282653 - DNA, 1854 bp, Homo sapiens
gcgggcgggctgctgaggtggctgtcgccggccccgatggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282654 - DNA, 1061 bp, Homo sapiens
ttttaagaagtttaaaggagtttattcaaaagttgaacatttttaaaatttcacaaaactaaccagcaaagacagtaagccaatcctccatttaccccctttctgtcttggttaagggcagagacacatgtcagagggagactgcgtcccatgtagggagctaatgtgttcactagctattgcttctcgcagggtcgcagcatctacactcacttgcctcatccacactgtcacgttcaaagacaagaaataatcctgaaagtagatcccaaggccagaatgcaaaggaatagccagaagcccagaccagatcagtgggctaagggtttgtcaaaggcagaatctggtgacagctagggtgaggggggctttgtcattggaagcgaatccatcgcccatcttcgttgtcatcacggtttatgttttccttggcccttaggatccagaagttgccacggctgctagttgcgtcatccagtggacacctttatatgtacaatttggatcctcaggatggaggagagtgtgtcttaatcaaaacccacaggtgaagagactgcttttcaaaagacagcctttcgagagctggtcgtgtagagttgtcccttcgccaagaacgacaagcttcagtgcccttgcattgatttgttcttcactggcagtctcagtggcaaacctctagtgggcaagtgctctgcaccgggctctgtgtcaggtgccctcagcatgtggtaatcatctggaaaagtgccaggattaataacacacaagatggtctccccctcagcctatgctcctaacacagccctgagctcacagtgggtgttcaaaaatattccctgccaccaggtgtggcggctcacacctgtaatcccggcactttgggaggccgaagcgggtggatggcttgagtccaggtgttcaagaccagcctgggcaacatggtgaaaccccatctataccaaaaacaaatacaaaaattagccggttgtggtggcacacacctgtagtcccagctactcaggaggctgaggtgggagaatcacctgagcctggagagg

SEQ ID NO: 282655 - DNA, 592 bp, Homo sapiens
ctacttaaaaaatagaaaaattagctgggcatgttggcacacacctgcaatcccagccactccggaggctgagacaggagaattgcctgaaccagagaggcggagattgcagtgagctgagaccataccactgcactccagcctgggtgaaagagtgagactctgtttcaaaaaataaaaactaaactaaaatttccaaagagcctgtagtcctagccactcaggaagttaaattgaggcagaaggatcccttaggctcaggagttcgagaccagcctgggcaacatactgagaccctacctcaacaaagaaaaattcaaagaggtaggatgcctcaggcatctgaagtggaaaggcaggtcaggcttaaagatggcagatggtgaggattatgacttgtcctaggcacagtacctccagggggaagacagacagcccctttgcttcctttgccctttatttgagcccccgctccccacccgccaggtcatggcataaaagcagatccccagtgcttgtttcatgtctctttcttggtttccaggttattctgaggacggcggggctcaaaaaaagggcgccgctagccgaa

SEQ ID NO: 282656 - DNA, 747 bp, Homo sapiens
  misc_feature (708)..(708): n is a, c, g, or t
  misc_feature (710)..(711): n is a, c, g, or t
  misc_feature (716)..(716): n is a, c, g, or t
gctttcttcagtccgaggtcgcgccgcctctccttgctgcagacgtggagtcttccagtttcgccttggtgcctgtcttcgccccacctggagcatcctccagatgctctcgtgccaggctgcttggtgcgagactctcctgttgccactctacgtgcccacgcacctctggtgtctcacacgccactgtctagctcgcgtgggctgaccctggggctggagctggacagggcccgtgctttccagcttagtgggctggcgatggctcggtagactactgggtaaatctccgccccggtctccgtgcccctccgtggtgtccctgatgaggtcctgtgtgggtgatgccctggaaggagctgggctttcctagttggggggatagcccgcatgtcgaggtgatggcttcatctgtactggatgatctgtgcgagtccgattagatatatctcctccctctgtagaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaagacnanncagcnctctaactgctggcagatagggaatcacaat

SEQ ID NO: 282657 - DNA, 309 bp, Homo sapiens
cggacgcgtgggttaaaaggggcctcctttttaatataaaattccggttatataccaatatggttaattagcatttacatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282658 - DNA, 705 bp, Homo sapiens
tcagataagccttctttaataggggaaagcagtagcattgggaaccttttaacagctttacaatggctcttctgaagaacaaacaagcccttgatgctctttagttattgccagaataatacgtcctggattgttctcagtgggcagaacattatgctaaggcacagtctctccctgctgcggggagtgtggctaatgacgcttgggtgtggagattcctgggtgcgtgtggggcctgcagcccagtcccatcgtcaagaacgacaagcttcagtgcccttgcattgatttgttcttcactggcagtctcagtggcaaacctctagtgggcaagtgctctgcaccgggctctgtgtcaggtgccctcagcatgtggtaatcatctggaaaagtgccaggattaataacacacaagatggtctccccctcagcctatgctcctaacacagccctgagctcacagtgggtgttcaaaaatattccctgccaccaggtgtggcggctcacacctgtaatcccggcactttgggaggccgaagcgggtggatggcttgagtccaggtgttcaagaccagcctgggcaacatggtgaaaccccatctataccaaaaacaaatacaaaaattagccggttgtggtggcacacacctgtagtcccagctactcaggaggctgaggtgggagaatcacctgagcctggagagg

SEQ ID NO: 282659 - DNA, 1925 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282660 - DNA, 1854 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaagtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282661 - DNA, 1636 bp, Homo sapiens
cacgaaccaagatctaacagttctcggaaccaagatctaacgtcggaaccaagatgagcatcggttcattggaaccaatatctaagagttctcccttcctttacatttcttctccgacaagaatgatttgaaacagaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282662 - DNA, 1554 bp, Homo sapiens
aaggcgagctcagggaggacaggtaagaatggaatggttgatagagagagcaataggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282663 - DNA, 932 bp, Homo sapiens
gagattgcgccactgcactccagcctgggcaatagagcaagaccctgcctcaaaaataaataaataacccacagagctgagcacaggcttcttcatgcttttcctttggaaggtgtcctagatatatgatgatttcttttttctttcacctcctcttgattgtcacaagtagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282664 - DNA, 1052 bp, Homo sapiens
ttatggagtcttgctccatcacccaggctctgtttcaaaaaataaaaactaaactaaaatttccaaagagcctgtagtcctagccactcaggaagttaaattgaggcagaaggatcccttaggctcaggagttcgagaccagcctgggcaacatactgagaccctacctcaacaaagaaaaattcaaagaggtaggatgcctcaggcatctgaagtggaaaggcaggtcaggcttaaagatggcagatggtgaggattatgacttgtcctaggcacagtacctccagggggaagacagacagcccctttgcttcctttgccctttatttgagcccccgctccccacccgccaggtcatggcataaaagcagatccccagtgcttgtttcatgtctctttcttggtttccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282665 - DNA, 606 bp, Homo sapiens
acataaacacaggatcctgacatccactagccgagagactttcaggggatgactcgcccctggaccccagctagtcagacatgatcctccagatggacagacaagtcccccaaatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282666 - DNA, 2670 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccgtaactgggcggctcagtctgtgtgcttagaaggaaaccttcgcctcatacgagaggcagagtccctttccctgttttctaatctataacaactaattctctgctctagtatttggaaagccataggatatttgttgtactgtgtgcttcgaatcctacagagtaggctttaggtgtcgagctaaaccctgatggcattagagtcaccgaatactaatccagggagtcttggtggcctccctccagccagaggcctgcgatcccttactttgcttctgtagcactgactttgctgcctggaaggtaggaacacgtgacttgtctaaaacttattttcctgaggctcccatggatgcgtttgcagaatgctgccttccttgtgctggaggggatggtttcagagggctgggctgtgtgttcaggactctgagctgagttgctgcactctgtgaaccagcttgaccctcacttacctgcagctctggccggcagacccgcacctccccagcagttgcagacaccggccggaagtagtgtttgggccaagacttggagcatcagctcctagagccagagaggagctgccacttgggcactgaaacaatgtccattaggctttgttatggaaacttctcctgatcattgttttgtgtccattgagcttccaattgtaaaaggatggagtgcaggtctggcttctttctcccgcagatccgtggaaccctctagtgagcacatttggcttagaaaacaaagctgcggtggggccctgcatgcagggctggggctgttgttttgtgatttcccacatcggctctgcgggtcggtcgcagcgtgagcttttacatttctggctttcaataggcaggttgtcagagacgtggctggcaagtgaagtttatatctcagtggcggagagcagttgttcttaaaaatactaattataaacttcaaaacctctgttggcatgctgcctaactataaaccagttgttttacctttgggttctcatggccccaactggccttaaagggcgttcttctgcaccctcaagaggcggtggttatttacctgaagtcgaggcttccaggatccagagcactctaggtcagacaccgtggggacaaatgtgaccattctactctgtcagggtttaccacatccagacactcactaggttccgtttcactaattttggtaaaagtctgtaactactataaaatattattagattcttaattgtaatcgcagtaagccttgcaacctct

SEQ ID NO: 282667 - DNA, 1810 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgggacaggaggaactctttaacttcttttaaatgcagtcatttcacccttaaaaggagaggaaggggattgggccacagacttatccatggactcgtctgctctgagatctggaaaacgacctaactttggtctaaatctgtgctcctcaaggcattgtttgatagaaatgtaggatttcaggatctactcgagccctactgagacggaatccggattctcacaagatcccaggtgatttgtttgcatattaaagatggagaccagtgagtacactggtttgtggaagg

SEQ ID NO: 282668 - DNA, 1679 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacaggtgaagagactgcttttcaaaagacagcctttcgagagctggtcgtgtagagttgtcccttcgccaagaacgacaagcttcagtgcccttgcattgatttgttcttcactggcagtctcagtggcaaacctctagtgggcaagtgctctgcaccgggctctgtgtcaggtgccctcagcatgtggtaatcatctggaaaagtgccaggattaataacacacaagatggtctccccctcagcctatgctcctaacacagccctgagctcacagtgggtgttcaaaaatattccctgccaccaggtgtggcggctcacacctgtaatcccggcactttgggaggccgaagcgggtggatggcttgagtccaggtgttcaagaccagcctgggcaacatggtgaaaccccatctataccaaaaacaaatacaaaaattagccggttgtggtggcacacacctgtagtcccagctactcaggaggctgaggtgggagaatcacctgagcctggagagg

SEQ ID NO: 282669 - DNA, 1390 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgtacgtacaatgacacccactctgaacaagaccacactttcgtcaatgtatttttccaaagcacaaaaatccccaaacctgaaaagaaaaaaagaaaacttgccccaggctgggcacggtggcttacatctgtaatcccggaaccttgggaggccaaggcaggcagatcatctgaggtcaggagtttgagaccagcctggccaacgtggtgaaatcccgtctctactaaaaatacaaaaattagccgggtatggtggtgcgtgcctgtagtcccagctacttgggaggttggggcaggagaatcgcttgaacccaggaggcggaggttgcagt

SEQ ID NO: 282670 - DNA, 263 bp, Homo sapiens
tgcctgtgcattactccctagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgtacgtacaatgacacccactctgaacaagaccacactttcgtcaatgtatttttccaaagcacaaaaatccccaaa

SEQ ID NO: 282671 - DNA, 1842 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282672 - DNA, 1307 bp, Homo sapiens
ttttaagaagtttaaaggagtttattcaaaagttgaacatttttaaaatttcacaaaactaaccagcaaagacagtaagccaatcctccatttaccccctttctgtcttggttaagggcagagacacatgtcagagggagactgcgtcccatgtagggagctaatgtgttcactagctattgcttctcgcagggtcgcagcatctacactcacttgcctcatccacactgtcacgttcaaagacaagaaataatcctgaaagtagatcccaaggccagaatgcaaaggaatagccagaagcccagaccagatcagtgggctaagggtttgtcaaaggcagaatctggtgacagctagggtgaggggggctttgtcattggaagcgaatccatcgcccatcttcgttgtcatcacggtttatgttttccttggcccttaggatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgca

SEQ ID NO: 282673 - DNA, 2062 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccgtaactgggcggctcagtctgtgtgcttagaaggaaaccttcgcctcatacgagaggcagagtccctttccctgttttctaatctataacaactaattctctgctctagtatttggaaagccataggatatttgttgtactgtgtgcttcgaatcctacagagtaggctttaggtgtcgagctaaaccctgatggcattagagtcaccgaatactaatccagggagtcttggtggcctccctccagccagaggcctgcgatcccttactttgcttctgtagcactgactttgctgcctggaaggtaggaacacgtgacttgtctaaaacttattttcctgaggctcccatggatgcgtttgcagaatgctgccttccttgtgctggaggggatggtttcagagggctgggctgtgtgttcaggactctgagctgagttgctgcactctgtgaaccagcttgaccctcacttacctgcagctctggccggcagacccgcacctccccagcagttgcagacactcattaagaaacaagtggccgggtgcggtggctcacacctgtaatcccagcactttgggaggccgaggctggaggattgcttgagcccaggagttagagaccagcctgggcaacacagcaaaaccccatctccaccaaa

SEQ ID NO: 282674 - DNA, 1858 bp, Homo sapiens
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccgtaactgggcggctcagtctgtgtgcttagaaggaaaccttcgcctcatacgagaggcagagtccctttccctgttttctaatctataacaactaattctctgctctagtatttggaaagccataggatatttgttgtactgtgtgcttcgaatcctacagagtaggctttaggtgtcgagctaaaccctgatggcattagagtcaccgaatactaatccagggagtcttggtggcctccctccagccagaggcctgcgatcccttactttgcttctgtagcactgactttgctgcctggaaggtaggaacacgtgacttgtctaaaacttattttcctgaggcaggagaattgcttgaacctgggaggcagaggttgcggtgagccgagatcgcgccattgcactccagcctgggcaacgagagcaaaactccatctcaaaaaagaaagaagaaa

SEQ ID NO: 282675 - DNA, 826 bp, Homo sapiens
  misc_feature (787)..(787): n is a, c, g, or t
  misc_feature (789)..(790): n is a, c, g, or t
  misc_feature (795)..(795): n is a, c, g, or t
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaattggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaagacnanncagcnctctaactgctggcagatagggaatcacaat

SEQ ID NO: 282676 - DNA, 341 bp, Homo sapiens
aggccccagaaagctgccttctaccatgtgaggacacatctatgagccaggaaatgggctctcaccagacagtgaatccgccagcaccttgatcttggacttcccagccaaaagaatgatctttcagattctttcaagactcaagcctaggttattacctgcacttaaaaccagctgacagagacaaagatgaaggaaaaacaaatcactccttgggaattacatacctgatctctctgatttccaaatttcccaaagctacacacacgagattatacacatcaggcactggaactatctgtaatactggaacctaaataaaacaaagctgacggccgaaa

SEQ ID NO: 282677 - DNA, 644 bp, Homo sapiens
aggccccagaaagctgccttctaccatgtgaggacacatctatgagccaggaaatgggctctcaccagacagtgaatccgccagcaccttgatcttggacttcccagccaaaagaatgggtcttgctctgttgccaggcttgagtgaagtggtatgatttcagctcactgcagcctccacctcccagtcaaggctggtggcatgcatctgtggtcctgctactcgggaggctgaggtgggaggactgcttgagcctgagaggttgagacttcagtgagccatagtcatgccactgtactccagcatgggcaacagactgagaccctctctcaaaaaagcaaaaacaaaaaaacaaccaaggcagtatgaattcggagaaggaaacatcaatgaaggctggaatagtacaacagaactcaagatctttcagattctttcaagactcaagcctaggttattacctgcacttaaaaccagctgacagagacaaagatgaaggaaaaacaaatcactccttgggaattacatacctgatctctctgatttccaaatttcccaaagctacacacacgagattatacacatcaggcactggaactatctgtaatactggaacctaaataaaacaaagctgacggccgaaa

SEQ ID NO: 282678 - DNA, 451 bp, Homo sapiens
tattaggaggtggggcttttgagaagtgattggtggttttgtaaaacaggccccagaaagctgccttctaccatgtgaggacacatctatgagccaggaaatgggctctcaccagacagtgaatccgccagcaccttgatcttggacttcccagccaaaagaatggtaagaaatacactttgttgtttaaaggctacccagtctgtggtattttgttgtagcagcctaatagaactaagatatgcttcctacaggattggtaccaaacaggctttcaaggattcctgaacagatgagtttgaaaagtgacaaaggaaatgcttgaccaagcagttatctttatctttaatctctagggccaacgactatcgttctctcttcaaatccaaggaagcaagttttatatgaaagcacatactgcagatgatagttctgaggttcttaggttctt

SEQ ID NO: 282679 - DNA, 911 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacagtgaagggagagaagtggatttgggagacatttaggaggaacagtaagaggaccttgtgcatgaataatttgtttccacactacagaagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaatatttgttttatttggaatccatgtatttgtaattttagtgtttgtattaatataagggagaaatgtttaaatctgtctatgccatatgtgcctctggcttattgcccaattaattgtagactcaggctaaactttggtttctgtctttaatttttgtcagaagaaatataactgatctcaaaac

SEQ ID NO: 282680 - DNA, 1029 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagagagcctacgactagatttgcatctttacgtcctgcgcggaggctgctacacacatgcagaagtcatgctggtggcctggacagtgaagggagagaagtggatttgggagacatttaggagatggcaccaaaagcgaaggaagctcctgctcatcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcatcaagtttccgctggccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaggagaacaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctata

SEQ ID NO: 282681 - DNA, 1042 bp, Homo sapiens
gcaataaaaaacagcggcggcgggaaccgagcgtgctgaacgaaatgccaggatggagtgctgcaggtctagttgacgtggtagtctatcgaacgaggagtccgaagcgagctcgatcatcaagagttacggccccgcctgagagcctacgactagatttgcatctttacgtcctgcgcggaggctgctacacacatgcagaagtcatgctggtggcctggacagtgaagggagagaagtggatttgggagacatttaggagatggcaccaaaagcgaaggaagctcctgctcatcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcatcaagtttccgctggccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaggagaacaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctata

SEQ ID NO: 282682 - DNA, 863 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcaggtacgccgcccatgtgcctgtggagaagagaggttcctgtggggcagacaggtgtggaccaagtagctgcgaaatttcttctgaagaaaacacacaagggggaagcgagtgagctcagtggaggaggggcgctaccccaggggacgtccccatgcatgggcttgtgaacctcgaatatgtgagacggtctcagtcaatttagaaagtttattttgccaaggttgaggacgcacgcccgtgacacagcctcaggaggtcttgacatgtgccaaaggtggccgggacacagcttgcttttatacatgttagggagacaggagacatcaatatatgtaagatgaacgttggttccctcgggaaaggcgggacaactcgaagcagggagggggcttccaggtcacaggtaggtgagagacaaactgttgtattctttcgggtttctgaatagcctccgcaaaggaggctatcacatattaacctatctcagtgagcagaggggtgactttgaatagatggggaggcaggtttgccctaagcagttcccagcttttttccctttagcttagtgattttggggccccca

SEQ ID NO: 282683 - DNA, 820 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacagtgaagggagagaagtggatttgggagacatttaggaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaa

SEQ ID NO: 282684 - DNA, 759 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagagagcctacgactagatttgcatctttacgtcctgcgcggaggctgctacacacatgcagaagtcatgctggtggcctggacagtgaagggagagaagtggatttgggagacatttaggaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaaaaaaaacaatatcctttctccaccaccaatccctcctccctattctctccactcctctatattggcgggcttaaaccgcgaagggaaaccc

SEQ ID NO: 282685 - DNA, 442 bp, Homo sapiens
actgaaaggttcacgaggctgtaacgaagagtcgagttgctccagagagcctacgactagatttgcatctttacgtcctgcgcggaggctgctacacacatgcagaagtcatgctggtggcctggacagtgaagggagagaagtggatttgggagacatttaggagagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaa

SEQ ID NO: 282686 - DNA, 668 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagagagcctacgactagatttgcatctttacgtcctgcgcggaggctgctacacacatgcagaagtcatgctggtggcctggacagtgaagggagagaagtggatttgggagacatttaggaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaa

SEQ ID NO: 282687 - DNA, 777 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcaggtacgccgcccatgtgcctgtggagaagagaggttcctgtggggcagacagagagcctacgactagatttgcatctttacgtcctgcgcggaggctgctacacacatgcagaagtcatgctggtggcctggacagtgaagggagagaagtggatttgggagacatttaggaggaacagtaagaggaccttgtgcatgaataatttgtttccacactacagaagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaa

SEQ ID NO: 282688 - DNA, 862 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacagtgaagggagagaagtggatttgggagacatttaggagagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaatatttgttttatttggaatccatgtatttgtaattttagtgtttgtattaatataagggagaaatgtttaaatctgtctatgccatatgtgcctctggcttattgcccaattaattgtagactcaggctaaactttggtttctgtctttaatttttgtcagaagaaatataactgatctcaaaac

SEQ ID NO: 282689 - DNA, 635 bp, Homo sapiens
ctaggctagagtgcagtggcgcaatcatagctcaccacagcctggatgtgttaacctcttaatgggtgttttagcccaactgagtttagattcataggttagagacactgaaaattggcagtaattcttgagtccagtcaaaactgaaccacagtgttctcatgcactcaccttccctcagatgcactgtttccaccatggtctttgtatctgggacaaccttttgcctgagatactgctagtggatgaagactgccttgttttctaattgttgtgtctgtggaggccaatgttatggtaatctttgacgtcaagttaactacttggattcttattttttgttactgtttgaaatgaggcatataaagagactagcattgaacttgggagctgggtataccaagatacattctccgaaagttctgtttgttattaaagtggcaatttgctttacacctgcctgccatttctattctttgttgtttttaaacttgagtggggataaagggggtgttatttattgggtaaccttcccaaactacaacacctaccctcacttttactgtacaggcgtgctgttgaggatggtcaaagtaactataaaatactaaaccagaggccgggcgcggtggctc

SEQ ID NO: 282690 - DNA, 1102 bp, Homo sapiens
  misc_feature (1)..(1): n is a, c, g, or t
  misc_feature (5)..(8): n is a, c, g, or t
ngcannnngcgagactccgtgggcgtaggaccctccgagccacatgcaggatataatctcccggtgtgccgttttttaagcccgttggaaaagcgcagtattagggtgggagtgacccgattttccaggtgccgtctgtcgcccctttctttgactcggaaagggaactccctgaccccttgcgcttcccgagtgaggcaatgcctcgccctgcttcagctcgtgcacggtgcgctgcacccactgtcctgcgccccctgtctggcactccctagtgagatgaaccctcagatggaaatgcagaaatcacccgtcttctgcgtcgctcacgctgggagctgtagaccggagctgttcctattgggccatcttggctccaccaccctgagatagggtctcactctgtcgcccaggctggagtgcggtggcgcgatcacggctcactgcagcctccaactcctggactcaagcgatcctccctcctcggcatccctggactataggcgtgagccaccgcttacgggcgaagacttgcttgtccgtgtccttgccatctaagtggagagcctacgactagatttgcatctttacgtcctgcgcggaggctgctacacacatgcagaagtcatgctggtggcctggacagtgaagggagagaagtggatttgggagacatttaggaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaa

SEQ ID NO: 282691 - DNA, 1181 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacagtgaagggagagaagtggatttgggagacatttaggagatggcaccaaaagcgaaggaagctcctgctcatcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcatcaagtttccgctggccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaggagaacaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctata

SEQ ID NO: 282692 - DNA, 1609 bp, Homo sapiens
  misc_feature (1)..(1): n is a, c, g, or t
  misc_feature (5)..(8): n is a, c, g, or t
ngcannnngcgagactccgtgggcgtaggaccctccgagccacatgcaggatataatctcccggtgtgccgttttttaagcccgttggaaaagcgcagtattagggtgggagtgacccgattttccaggtgccgtctgtcgcccctttctttgactcggaaagggaactccctgaccccttgcgcttcccgagtgaggcaatgcctcgccctgcttcagctcgtgcacggtgcgctgcacccactgtcctgcgccccctgtctggcactccctagtgagatgaaccctcagatggaaatgcagaaatcacccgtcttctgcgtcgctcacgctgggagctgtagaccggagctgttcctattgggccatcttggctccaccaccctggcgtgctgttgaggatggtcaaagtaactataaaatactaaaccagaggccgggcgcggtggctcatgcctataatcccagcactttcggaggctgaggtgggcggatcacaaggtccggagatcaagaccatcctggctaataagagatagggtctcactctgtcgcccaggctggagtgcggtggcgcgatcacggctcactgcagcctccaactcctggactcaagcgatcctccctcctcggcatccctggactataggcgtgagccaccgcttacgggcgaagacttgcttgtccgtgtccttgccatctaagtggagagcctacgactagatttgcatctttacgtcctgcgcggaggctgctacacacatgcagaagtcatgctggtggcctggacagtgaagggagagaagtggatttgggagacatttaggagatggcaccaaaagcgaaggaagctcctgctcatcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcatcaagtttccgctggccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaggagaacaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctata

SEQ ID NO: 282693 - DNA, 732 bp, Homo sapiens
cgcggcgcctggcgggagggccgcagggagtgcgcatgcggccgagtgcgggactggggctcctggctgtgggtgtggtaccgaggcttcagcgggtgccgcccgcctagagggagtggagcggtgaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagaccaccagttctaaccttcaaaaaccaaacctgtttgtgagatctccttcaaatactactgtagaccccagtgtttattcattaaatttttaaaatatttgttttatttggaatccatgtatttgtaattttagtgtttgtattaatataagggagaaatgtttaaatctgtctatgccatatgtgcctctggcttattgcccaattaattgtagactcaggctaaactttggtttctgtctttaatttttgtcagaagaaatataactgatctcaaaac

SEQ ID NO: 282694 - DNA, 803 bp, Homo sapiens
tagctctgatgtcctgagtctataaatgactggccccttccttcaatcaagaaataacctcactacacccagctgtgggagagaataaaaatccaagacttcccaaaggctgagctgagagcaaagaggctgcttctctcgtggcccagcctcgctctctgcaggtcccccagctcacactgtacggcccacagacctccatctgcttgaccagcctgctgcggtcatctttgaggtgactcttggcttccagctcatactccaggtccttcagcgtctgctccagaagctgcctttttgtggcactcaactaacagctttgaagaaagcgcaacagacaaaacagcttgattcacaagggccagtcagtgtcttgaacttctctagaagctccctggggagaccagccagctcagggcacagtaggtcttccttaaacatctgtgtgggctgatctggtgaagccgcaggctgtctgctttgttctaagtgtcctaccctcttggagttggtactagtattgagtagagctagtctcatgaatagaataatacaccagggggtctgtttccttcagagtatatgaaagtgaatggccatctccgctacagaatgccacccttctgcagtgtctggcacagaagagttggaaagccccagtagttgaggacagctttggagaacccgtggaaaagcttgaggaaatgtgttcttctctgggaggctgacaggagcactgggcatttctaagagaacagcctagccttgaagatgacatctccagatgaagacccacatctggt

SEQ ID NO: 282695 - DNA, 805 bp, Homo sapiens
acccggaggtgggatgggaaaactttattaggtttggtttccagcttcggccacgcgggctccgcccgccccgagctcgggtcaccttcaggtagcgctccagcttcttgctgatgagcttgttgttgagaatactgcgggccaccatgagggaggacttcttggactgctccatcatgagctgcgggcagggcagaaggagctggagaggctgctctgagtgccctacaagttgctgccccgaccctgccagcttagagggaccccaccccgcccctgcacccacgcacttccagccccaccaacggagggccactccacaagcatggaaccacaacctatctgatctttgttcaaattccctctccttccacaccacacttactgtaggtaaataaaaatacagatctatatatctctaactttacggctgtattacagaaatctgatttgcttacaaaaaagctataagcagtgaacaattaagaaactaagagccaaaggtgggtgcaacctgtaacaaggtgccaactaggctaataggcaaggagcactttggggccaacggggaagatataaaaacaggaacagatatttaatgaaacgtcttttttaacccacagaattccaagaatgaagaattattcccagtcatgcaagggtgaagagagtcttctctgctggtgggaggatcaactgtttccgtattttttggaaagcagtttgacacaatgtatgaaaagtaaaaatctgtctcattaatcccttcccagaacgtatcctaaatttaagaactggaaacatg

SEQ ID NO: 282696 - DNA, 279 bp, Homo sapiens
ccgcccccctagcgccgccattttgtggcgtcttcggaagaggaagccgggagtgcaaaccccggggtcgctgggggccggaaggactccgccgaagaattccaagaatgaagaattattcccagtcatgcaagggtgaagagagtcttctctgctggtgggaggatcaactgtttccgtattttttggaaagcagtttgacacaatgtatgaaaagtaaaaatctgtctcattaatcccttcccagaacgtatcctaaatttaagaactggaaacatg

SEQ ID NO: 282697 - DNA, 2039 bp, Homo sapiens
  misc_feature (1453)..(1453): n is a, c, g, or t
gttttcttttcctttctttctctctctctcgcttctctcctctccttttctctctctttcgcaataaagacaggaaaaaggcggggggaaacatggagaaagcttcccacggataatcccatggagtctaaaagggacatgccgagggctggcagggctgggaggcctttgggaagctcagaggagccgcggggagccgggcgtacgagagcaggccgggactccgctgggcgaggccgagcagggacaccagctcctcacccagttgaaacttgcggtcactggagaggagcaacgcaggagctgatctggtttgaaaaagaggtcaaagcactttacagctcccatttcccagcgccgaggagtggtgagttttccgtgttccaagccccactgttctgcctccgggagagtttgcagctgctttcggggaaggtggctggctctgctcacctgctctgccctccctgacaagagcacctgctgtgtgcccacacttcggctcccgaggtctactttgctcctcctgacaccccaggaggctggcccctcctggctctggaggagacatgaggctcaggagagctgcatctgtgccagcgacagcaggtgcatcccacaccagggcaggggtctgcaccggcctcctgtctgtcttcttccttttggaaaacaatgggaagaaaacacatcctgccggtggctgtacctcaggaagccccacggcctgcactgttccctgcccatgccaacaggctaccctctctgcccgcgtccacgtggggagcttttccatcagcatctgcacacccagacgtgagggtgcagctctcatctgctgtgcctcagatctggatttaacacttgggaggggctgctgggctcaccccctcagctctgagtctgcacttagctttcatttgcaaatgataaattctgccttgcacaggcgtgctggctgcagggcagtgcaaattcaatccttttcaagtctggccaaaaacatgccccaaattaagagattgcagcctatttacaatacaaaataaaataactctaggagggcttggtggtggtatgaataaatgccgtttattctctttctgacgggataattttcaaagcagtgatttttataaaaactcaggaagaaaacaattttgtttcatttccataacagaatccagaccttgagcttcaccctgcgatcagtgattacacacacaccgcaccgtttcggctgcagcggctcctgctgtccaccggctcccgtcctccctgcctgtaaccgtctgtggtgattcgcggcactgcaggaccatgatggcccggatctgctcggacgctccgcctcagcttctcatggccgccctcgctattgccacccctgcccaggctgcatcaaggaggtcaggggccaggggagaactcttttgttattgagaagtttgantgcaagacctgacccttcctgtgtggacggatgggcagatgcccagactggaaagtccttgtgaacttatgcgcccaggccaggtccatatcatcagctcgtagaagccagcacagcccagtgattcatatgcccaggccaggtccatatcatcagttcgtagaagctagcacagaccagtgattcatatgcccaggccaggtccatatcatcagctcacagaagccagcacagcccagcgagtagccctacagactccacgtggcccatgagtatcacggtcactgcactgggagccccacctgtagcttcgggtggaaactaggtacagaatacagaagcacgcatcctacccgcaccatactcgtggcctgatgtgagcagattactgccgcagacttcgaaggggatgagatgctggctgcgtacaggatcctgtttcttaaagcgagagccactgcaccccagagccccagccgcctgcgccagacaaccttccccagagaaaggtgcccgagtcggcgatcaaaacgctctcggctcacacggcctttgaagccgcacatgggcagcccctgcgtatgga

SEQ ID NO: 282698 - DNA, 1980 bp, Homo sapiens
  misc_feature (1453)..(1453): n is a, c, g, or t
gttttcttttcctttctttctctctctctcgcttctctcctctccttttctctctctttcgcaataaagacaggaaaaaggcggggggaaacatggagaaagcttcccacggataatcccatggagtctaaaagggacatgccgagggctggcagggctgggaggcctttgggaagctcagaggagccgcggggagccgggcgtacgagagcaggccgggactccgctgggcgaggccgagcagggacaccagctcctcacccagttgaaacttgcggtcactggagaggagcaacgcaggagctgatctggtttgaaaaagaggtcaaagcactttacagctcccatttcccagcgccgaggagtggtgagttttccgtgttccaagccccactgttctgcctccgggagagtttgcagctgctttcggggaaggtggctggctctgctcacctgctctgccctccctgacaagagcacctgctgtgtgcccacacttcggctcccgaggtctactttgctcctcctgacaccccaggaggctggcccctcctggctctggaggagacatgaggctcaggagagctgcatctgtgccagcgacagcaggtgcatcccacaccagggcaggggtctgcaccggcctcctgtctgtcttcttccttttggaaaacaatgggaagaaaacacatcctgccggtggctgtacctcaggaagccccacggcctgcactgttccctgcccatgccaacaggctaccctctctgcccgcgtccacgtggggagcttttccatcagcatctgcacacccagacgtgagggtgcagctctcatctgctgtgcctcagatctggatttaacacttgggaggggctgctgggctcaccccctcagctctgagtctgcacttagctttcatttgcaaatgataaattctgccttgcacaggcgtgctggctgcagggcagtgcaaattcaatccttttcaagtctggccaaaaacatgccccaaattaagagattgcagcctatttacaatacaaaataaaataactctaggagggcttggtggtggtatgaataaatgccgtttattctctttctgacgggataattttcaaagcagtgatttttataaaaactcaggaagaaaacaattttgtttcatttccataacagaatccagaccttgagcttcaccctgcgatcagtgattacacacacaccgcaccgtttcggctgcagcggctcctgctgtccaccggctcccgtcctccctgcctgtaaccgtctgtggtgattcgcggcactgcaggaccatgatggcccggatctgctcggacgctccgcctcagcttctcatggccgccctcgctattgccacccctgcccaggctgcatcaaggaggtcaggggccaggggagaactcttttgttattgagaagtttgantgcaagacctgacccttcctgtgtggacggatgggcagatgcccagactggaaagtccttgtgaacttatgcgcccaggccaggtccatatcatcagctcgtagaagccagcacagcccagtgattcatatgcccaggccaggtccatatcatcagctcacagaagccagcacagcccagcgagtagccctacagactccacgtggcccatgagtatcacggtcactgcactgggagccccacctgtagcttcgggtggaaactaggtacagaatacagaagcacgcatcctacccgcaccatactcgtggcctgatgtgagcagattactgccgcagacttcgaaggggatgagatgctggctgcgtacaggatcctgtttcttaaagcgagagccactgcaccccagagccccagccgcctgcgccagacaaccttccccagagaaaggtgcccgagtcggcgatcaaaacgctctcggctcacacggcctttgaagccgcacatgggcagcccctgcgtatgga

SEQ ID NO: 282699 - DNA, 1464 bp, Homo sapiens
gagccgctgggcaacagcccaatgggcctggagagagctggcttcccaccgggcctgggatcggacctgcagggctgtgctgggcctgtggcgtcagtggctgctgcagtcacggctggtggagcggtgggcccaggagcggggctggcggctggcacgagatgccctatgccactggcactcctgttggcaggcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagcagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagagtaaggagaccttgccccgggggacaaacggtgtctgaagtgcaggggtgaagcggtctccagtcctcaggggcctggaaatcagctccttgggacacggtcttatgtgtattgaccattctccccatccattccctcttcggaatgtttcagctgttctgagaaaacactttgcattcctgccccgcccctgtgatttctctttgggcggcaggcagccgggagaggctggaggcctggggagatgggggcagggcacaaggctaagctcagcaccttcctccaccctcctcactgtactcaactcctaggcgggcactaagagcagctgccttcctggacccaccttaacctcttgtgactcaactcccctttccagggtgcagggaacattccctctgccctgccttccagctctggccacagtggcctggacagagtagctgggtcccaggcctgcccc

SEQ ID NO: 282700 - DNA, 633 bp, Homo sapiens
cacaggccccacttccttctgaggagagctcccttctggccaggcctatttcaagtttgagggatgaagaatccacacaatggggctgacagtgaccaaactagaggagacatatatactccagcccaattctgcactgaaggacaaggactgctgcaaaagaaatgagtgagaccctcaaaataaatgaaaggcacacagctcagccactaaggagatggacaagccatgtcaacctctgatctgctactttttgcatctataaaatggtaacactgctacttatacctcaggatgttgtgaggattaaaaattgagtaagctaagtgcctggtgcagtcctggcacagtcactaagcatttactatccttatgcagtttctttttgtaatgctaactgccctccaaattcctccaaagtaaacacatggattagtaaatgagaaagaaacaatgcttaaaacaactatgggtaacatacctgtttcaagtcgcgtagaatactgatataagaaatataaattgaccaaataaagaaatccagttcctggacccacagggaaataaaaggtggcagtgattggcctccaaatctgtccagatcaaaataaacacagctgttagtttctgtaa

SEQ ID NO: 282701 - DNA, 1202 bp, Homo sapiens
agcagcacctttgagcgatggcggcgtctggggaaccccagaggcagtggcaagaggaggtggcggcggtggtagtggtgggctcctgcatgaccgacctggtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaacc

SEQ ID NO: 282702 - DNA, 1326 bp, Homo sapiens
aaaatgatgaaaaggaaaaaaaataacaatagtttaccagttttcatccaccagattagcaaacatttaaaaatatgataactctgaacgttagcaagaacatgaaaaagtgggaactcttaaacacaaattgtaggaacttaaattggtacagccaatttggaagaaactgtggcatcttctagaaaaatagtatgtatattctttttttttttttttttttgagatggagtctcgctctgtcacccaggctagagtgcagtggtgcgatatctcagctcactgcaacctctgcctcccaggctccaagcaattctcctgcctcagcctcccaagtagctgggattacaggcgtgcaccaccatgcctggctaatttttgtatttttatagagatggggtttcaccatgttggccaggatggtcttgatctcttgaccttgtattctgcccacctcagcctcccaaagtactaggattacaggcatgagccaccatgcctggccttttttttttgagacagagtctcgctcagttgcccaggctcgagtgcagtggcgtgatttcagctcactgcaatctccacctcccaggttcaagcaattctcctgcctcaacctcccgagtagttgagactacaggcccccgccaccacacccagctgattttttttgtttttttagtagagacagggtttcaccatattggccaggctagtcttgaactcctgacctcaggtgatccacctgcctcggcctcccaaagtgctgagattacaggtgtgagccatggcgcctggcaaaatagtttataatttaaaaaataaattttctctttctagaactagagatagaaaaaataataaaaatttttttcagcaaaagaggggtcatgatagggagaagtgagaggggggcacaaaagtacacattggaggaaataatgaaattcatttcagttcaacaacaaacttactgagaacagatgaatgaaaccttgcctgtcctataaggaatacagtcatctgccagaagaaaaatggtgattcttcccagtccaaaggtgaagatggtgactgtgaaagtatcagctttagccagaccactgatgaagctcccagatgtcacagcatccatgggcttgtgatctcaggtgaaggcgttgaaccctgagccctggattcccatctcttcacttgctccctccaccaccccacccccatattcagaatggcctctaggcttctaggtttgtgtctttaatggcacctaggcaataaataaaaaatacagtgcagtgctgactgcatcttccctacagctctttg

SEQ ID NO: 282703 - DNA, 681 bp, Homo sapiens
aagaaaacagatgtaggggaggacttcctgagtaaaacacaaaaagcacaaagtaaaaggtaaaatattatttcaggctgggcgtggtgcttcacgcctgtaatcccagcactttgggaggccgagattacaggtgtgagccatggcgcctggcaaaatagtttataatttaaaaaataaattttctctttctagaactagagatagaaaaaataataaaaatttttttcagcaaaagaggggtcatgatagggagaagtgagaggggggcacaaaagtacacattggaggaaataatgaaattcatttcagttcaacaacaaacttactgagaacagatgaatgaaaccttgcctgtcctataaggaatacagtcatctgccagaagaaaaatggtgattcttcccagtccaaaggtgaagatggtgactgtgaaagtatcagctttagccagaccactgatgaagctcccagatgtcacagcatccatgggcttgtgatctcaggtgaaggcgttgaaccctgagccctggattcccatctcttcacttgctccctccaccaccccacccccatattcagaatggcctctaggcttctaggtttgtgtctttaatggcacctaggcaataaataaaaaatacagtgcagtgctgactgcatcttccctacagctctttg

SEQ ID NO: 282704 - DNA, 464 bp, Homo sapiens
tttttttttacttaaactggtcttgtagtctttattgactgtttgtaccaaattgactccaggagaaatggaaaatctaattagatctataactcttcaagacattgaaattacagctttaaattttacaataaagaatattctggccaggcatggtggctcacgcgtgtaatcccactgcactccggcctgggcaatagggcaagactccgtctcaaaaaaaccagaatattctaggctcaaatggtattacagatgagtctaccaaacattcaaggagcaattaattccaatcttaaattcttcaaataataattaaaaaaaggctgggtgcagtggctcatgcctgtaattccagcactttgggagcccgaggtgggtggatcgtgaggtcaggagatcgagaccctcctggctaacacggtgaaaccctatcgctactaaaaatacaaaaaattatctgg

SEQ ID NO: 282705 - DNA, 1239 bp, Homo sapiens
aaaatgatgaaaaggaaaaaaaataacaatagtttaccagttttcatccaccagattagcaaacatttaaaaatatgataactctgaacgttagcaagaacatgaaaaagtgggaactcttaaacacaaattgtaggaacttaaattggtacagccaatttggaagaaactgtggcatcttctagaaaaatagtatgtatattctttttttttttttttttttgagatggagtctcgctctgtcacccaggctagagtgcagtggtgcgatatctcagctcactgcaacctctgcctcccaggctccaagcaattctcctgcctcagcctcccaagtagctgggattacaggcgtgcaccaccatgcctggctaatttttgtatttttagtaaagacagggtttcactatgttggccaggctggtctcaaactcctggcctcaagtgatgcgctcgcctcggcctcccaaagtgttaggattacaggcatgagccaccacacccagccccagcaggattttctaggctaaatcctagaaaatcttgcttgtgaaaatgtacaaaaaagttcagaggctcgttgtttttaatagcaaaaacctaggaacaccaaatacccatttggagaagaatgtgtaactaaatggtggcatatttacatcgtgggatgaaagtgtattattaataactggcatgtcatccatccgcatggataaatctcacatttggtgaacaaggaaaggaatctgcagaatacaaacgctgtaacgctgtttacataaaatataaaaccatgtaaaactacacagtatgctggtggaggtgcatacatatgtagtaaatgtatagagaaaagctaaaagcaagaagttcaaaattcaaaatgctggttatttctggtgggggaaggggagactgcaattcagggcacaaagggaccactataagggatgataaggttttgcttcttaaactgggtggtaggcacatgagtggacatattatttgttaatccttttgtgcataataaaataatttttttttcttttttttgagatggagtctcactctgtcacccaggctggagtgcggtggtgcaatatcggctcactgcaacttctgcctcccaggttcaagcaattctcctgcctcagcctcccgagtagctgggactacaggcccacgccaccacacccagctaaagcaggagaatcgcttgaacctgggagacggaggttg

SEQ ID NO: 282706 - DNA, 599 bp, Homo sapiens
tttttttttacttaaactggtcttgtagtctttattgactgtttgtaccaaattgactccaggagaaatggaaaatctaattagatctataactcttcaagacattgaaattacagctttaaattttacaataaagaatattctggccaggcatggtggctcacgcgtgtaatcccactgcactccggcctgggcaatagggcaagactccgtctcaaaaaaaccagaatattctaggctcaaatggtattacagatgagtctaccaaacattcaaggagcaattaattccaatcttaaattcttcaaataataattaaaaaaaggctggaaactgggtggtaggcacatgagtggacatattatttgttaatccttttgtgcataataaaataatttttttttcttttttttgagatggagtctcactctgtcacccaggctggagtgcggtggtgcaatatcggctcactgcaacttctgcctcccaggttcaagcaattctcctgcctcagcctcccgagtagctgggactacaggcccacgccaccacacccagctaaagcaggagaatcgcttgaacctgggagacggaggttg

SEQ ID NO: 282707 - DNA, 1178 bp, Homo sapiens
aaaatgatgaaaaggaaaaaaaataacaatagtttaccagttttcatccaccagattagcaaacatttaaaaatatgataactctgaacgttagcaagaacatgaaaaagtgggaactcttaaacacaaattgtaggaacttaaattggtacagccaatttggaagaaactgtggcatcttctagaaaaatagtatgtatattctttttttttttttttttttgagatggagtctcgctctgtcacccaggctagagtgcagtggtgcgatatctcagctcactgcaacctctgcctcccaggctccaagcaattctcctgcctcagcctcccaagtagctgggattacaggcgtgcaccaccatgcctggctaatttttgtatttttagtaaagacagggtttcactatgttggccaggctggtctcaaactcctggcctcaagtgatgcgctcgcctcggcctcccaaagtgttaggattacaggcatgagccaccacacccagccccagcaggattttctaggctaaatcctagaaaatcttgcttgtgaaaatgtacaaaaaagttcagaggctcgttgtttttaatagcaaaaacctaggaacaccaaatacccatttggagaagaatgtgtaactaaatggtggcatatttacatcgtgggatgaaagtgtattattaataactggcatgtcatccatccgcatggataaatctcacatttggtgaacaaggaaaggaatctgcagaatacaaacgctgtaacgctgtttacataaaatataaaaccatgtaaaactacacagtatgctggtggaggtgcatacatatgtagtaaatgtatagagaaaagctaaaagcaagaagttcaaaattcaaaatgctggttatttctggtgggggaagaaactgggtggtaggcacatgagtggacatattatttgttaatccttttgtgcataataaaataatttttttttcttttttttgagatggagtctcactctgtcacccaggctggagtgcggtggtgcaatatcggctcactgcaacttctgcctcccaggttcaagcaattctcctgcctcagcctcccgagtagctgggactacaggcccacgccaccacacccagctaaagcaggagaatcgcttgaacctgggagacggaggttg

SEQ ID NO: 282708 - DNA, 476 bp, Homo sapiens
acttgggcatgccagcatgctgggatctccgttgctgccagctaacgtggattttcttctcttaaggtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatcaaaaaa

SEQ ID NO: 282709 - DNA, 503 bp, Homo sapiens
gaagcggttgctgatgaactcgcagatgccgctcagggtcagcttcttctgcgggctctgcaggatggccatggtgatgagcgcgatgtacgagtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatcaaaaaa

SEQ ID NO: 282710 - DNA, 507 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtaggtacggcccatttttcttaacgccgcccttccaagccctttggcgctagtcccgggtctgccgcgatcgtttccttgcggtaggccgcaggagggcctttcctccccctcagttcaatgggattcttgggctcttctcccagacgctgagggaacagccacagacattgtctctcctctccgtgactcctttccttactccgtcatcccacatctctcttgtttgttctcttttcctcctgtttttcttattttacaaatactcgccagtaagaaagaagagatctgtcagttaagattgacctcaaaattaattttattaagcgtgtactattttacaaacggtggatccctgcaaataaaccttcacatacatgatcct

SEQ ID NO: 282711 - DNA, 1581 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggtaagaataattagagcacaaaaaatatgaaattcaaaaatatttaagaaaattataaatacatttatttttatttacaatatatctttggctacaacgaccttcttcagaaacacatgttgatacagtgtcatattttcatattgctcttcctttacactgggtgctcttttttttttataaaccaaggacagccctgaatatcttccctgagttatctgaagaaataaatataagatttctttcctgagggaacata

SEQ ID NO: 282712 - DNA, 1728 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaat

SEQ ID NO: 282713 - DNA, 1694 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaat

SEQ ID NO: 282714 - DNA, 1805 bp, Homo sapiens
aagtgctggtacgccccgggattacgggatctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaat

SEQ ID NO: 282715 - DNA, 1737 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacagttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaat

SEQ ID NO: 282716 - DNA, 1865 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaat

SEQ ID NO: 282717 - DNA, 1545 bp, Homo sapiens
agcggggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatgttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtgtggcctccgtctttcacccaggctggagtgtggtgtcacgatctcagctcactgcaaactctgcctcccgggttcaagtgattctcctccctcagcctcccgagtacctgggaccacaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaat

SEQ ID NO: 282718 - DNA, 2162 bp, Homo sapiens
  misc_feature (37)..(37): n is a, c, g, or t
gcgcgcggtagcgcgggcccctcagtgcacaatggcnagagcaggcggcggagccccagccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttt

SEQ ID NO: 282719 - DNA, 2409 bp, Homo sapiens
  misc_feature (37)..(37): n is a, c, g, or t
gcgcgcggtagcgcgggcccctcagtgcacaatggcnagagcaggcggcggagccccagccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacagcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctat

SEQ ID NO: 282720 - DNA, 2127 bp, Homo sapiens
  misc_feature (283)..(283): n is a, c, g, or t
  misc_feature (361)..(361): n is a, c, g, or t
gtagtacccatctctcgtggggtcagcgtgttagccctatcgtatggttcatggtcatagcaatggagatcgagtatgcgtggttgttgccgtacgacaggatgtccgtgtggtcgatggtagcgtaagctggcgtttgtgaattgcgtccagcccatctatacagaaagcgacctcgtgcagcgtcatagttggagcgattgcttgaaacgatgactactcaggactagtggaagtctcctggagcgtggtacacttgaccatgcgatctcataccttacantaggagattgctcacagacgactgacgtctctggctattcaagacttacccgacacgtaggcttgggagaccttacangcctttccgtttagtagtcgagaacgactccttcaggaccaaattcaaagttgactcaacgaattttttaaaacactacttgaaaatgaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctat

SEQ ID NO: 282721 - DNA, 2569 bp, Homo sapiens
  misc_feature (37)..(37): n is a, c, g, or t
gcgcgcggtagcgcgggcccctcagtgcacaatggcnagagcaggcggcggagccccagccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctat

SEQ ID NO: 282722 - DNA, 655 bp, Homo sapiens
  misc_feature (37)..(37): n is a, c, g, or t
gcgcgcggtagcgcgggcccctcagtgcacaatggcnagagcaggcggcggagccccagccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgagaagagttccagtcacaaatgcatatatgatgcattttgacatttactgctaagatgaaatgcagaaatgaaaccacacatccattttagtattctcagatgtgattagatgtacttgctcatgtttttatgctactgactta

SEQ ID NO: 282723 - DNA, 2249 bp, Homo sapiens
  misc_feature (37)..(37): n is a, c, g, or t
gcgcgcggtagcgcgggcccctcagtgcacaatggcnagagcaggcggcggagccccagccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctat

SEQ ID NO: 282724 - DNA, 1839 bp, Homo sapiens
cggacgcgtggtcgacccacgcgtccggaagagttcaaaaaggcttttctaacccgggactgacttctaggtggaaaaaatacatcgctgtaagaaaaccgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctat

SEQ ID NO: 282725 - DNA, 349 bp, Homo sapiens
ctgttcggtgccaagtagaataatttccaccactttccctgttcttcagtactactgcatagccaagctggtttattgttgcatataaagtctgggctgtcttccgaagtgctctgtttcatcaacagccgaggagaggagggagtgctaggtggaccagatgactgcaaagcgtgaggacctcgcttctcatgctgcttagaaagcacataggggtccttggagaaggactcccctgacgcgcctttcttctcctcaaagccctccattggcaggggcaatgtgggtgaaggatgtaaactggaaagggctggcggcatggagtgaaccatctggatcccaccaacgg

SEQ ID NO: 282726 - DNA, 2495 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagaggaaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaactggcacatcagttaattttgatcaaag

SEQ ID NO: 282727 - DNA, 2260 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagaggaaagaacccctccgatgcctaataaagttctctagcccacatcttctggaagcattgaaatccttagcaccagcggcacttgtttgcaggatccaaaagctgctctgctattctggaagccacagtcaagggacccaggacccgagcagctggcagaaggacttgtaccttctgtttgtcccattgtatccaagatgttaaaatcatgatgtcacaacatttagacatttaaatggttaatcaaatgtatgtctctcctgatatacagctaactgctatagactaatgcaggcctccttgttaaaatggaccctttgttactcaaatttgaccaatcttggaagcttggatgtgcactgacttgacaaccactttttgtgggacataacactctagacacaggtgcttctagctctaaggggaacagataactaatctgtggccaaccaaccaatgattaatcagctatgctgcctcggatcttgatcaaaaaaggaaaatgtgaaaagtgatacacaaaatggcatcactttggttcagagctctaaaatggagttgggaagccattctaagaaggactgcctgcacaatctgcaacttgcaaaacac

SEQ ID NO: 282728 - DNA, 1554 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccggtaagagagccccgggcggcactggatcgggccccggagggtgtggggccttgaggaagccagatcccaggcctcgggggtggctttttcgcaattgtcgcacgttgtgaggcgcaggattggcgctgggtctcgggctcggggcgaggaactacggttcgggccgagtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcagcggctgacaattggtttagaaaacaccatccgattggtaaatgggcctgagaagctgggtttcgg

SEQ ID NO: 282729 - DNA, 527 bp, Homo sapiens
tatatggaatttttctccaggcaccaaaaaagtttggggatgttttttcaaattgagtaaagggcccagggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtaaatctttattttctctttgacacaggagttagaagctactgggaaaatctacctccgacaagaggagatcattttagatattaccgaaatgaagaaagcttgcaattagtgaacatgaaaggaaaataaaaattcctcacagtc

SEQ ID NO: 282730 - DNA, 709 bp, Homo sapiens
tgtattggtggtgcttgcggaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtc

SEQ ID NO: 282731 - DNA, 1502 bp, Homo sapiens
tgctctgagtcatcccgttccattgcagcagcgctccaaagtttgggactttctccagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagaggaaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaactggcacatcagttaattttgatcaaag

SEQ ID NO: 282732 - DNA, 1669 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcagtggaggtggggtttcgccatgttgcccaggctggtctcaaactcccgacttcaagtgatcctcagcctcccaaagtgttgggacaggcatgagctaccgtgccccacctgggcttaacctactctaactcagaaatgattaccaaaagaaagaaccgattacctgctttaattttttttaaagttccaaatagaaaacaggaaccaacccatatccattaggatggctactgctgaaaaaaaacagaaaataacaaacgctaaagaggatatggagaaactgaaactcctgcgcactgtgggcgggcatgtaaactgggatagccactgtggaaaccggtatagcagt

SEQ ID NO: 282733 - DNA, 1440 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtc

SEQ ID NO: 282734 - DNA, 1808 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagaggaaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaat

SEQ ID NO: 282735 - DNA, 732 bp, Homo sapiens
tgctctgagtcatcccgttccattgcagcagcgctccaaagtttgggactttctccagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtaaatctttattttctctttgacacaggagttagaagctactgggaaaatctacctccgacaagaggagatcattttagatattaccgaaatgaagaaagcttgcaattagtgaacatgaaaggaaaataaaaattcctcacagtcatctttttataattgtattgtgttttataccactcattagtcactggagtctgtgttgtagatctcagcttccaaatcacctgatcacactagaatttgttttctctttagagaaacttcacattatcttttgaagctaaatatattattctatgaaacaacagagaagtagaattaactttttgtcccatcactcaagca

SEQ ID NO: 282736 - DNA, 1641 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtcatctttttataattgtattgtgttttataccactcattagtcactggagtctgtgttgtagatctcagcttccaaatcacctgatcacactagaatttgttttctctttagagaaacttcacattatcttttgaagctaaatatattattctatgaaacaacagagaagtagaattaactttttgtcccatcactcaagca

SEQ ID NO: 282737 - DNA, 1725 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccgtcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctccccgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtaaatctttattttctctttgacacaggagttagaagctactgggaaaatctacctccgacaagaggagatcattttagatattaccgaaatgaagaaagcttgcaattagtgaacatgaaaggaaaataaaaattcctcacagtcatctttttataattgtattgtgttttataccactcattagtcactggagtctgtgttgtagatctcagcttccaaatcacctgatcacactagaatttgttttctctttagagaaacttcacattatcttttgaagctaaatatattattctatgaaacaacagagaagtagaattaactttttgtcccatcactcaagca

SEQ ID NO: 282738 - DNA, 938 bp, Homo sapiens
tgtattggtggtgcttgcggaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcagtggaggtggggtttcgccatgttgcccaggctggtctcaaactcccgacttcaagtgatcctcagcctcccaaagtgttgggacaggcatgagctaccgtgccccacctgggcttaacctactctaactcagaaatgattaccaaaagaaagaaccgattacctgctttaattttttttaaagttccaaatagaaaacaggaaccaacccatatccattaggatggctactgctgaaaaaaaacagaaaataacaaacgctaaagaggatatggagaaactgaaactcctgcgcactgtgggcgggcatgtaaactgggatagccactgtggaaaccggtatagcagt

SEQ ID NO: 282739 - DNA, 875 bp, Homo sapiens
taagttctcccagggcgctgccagagccctgccggctaagggatggggaaacaaacaggtggggctgtaatctcgtaattcccagtcaaaagaggtaggaagggatgctgaggacccagggatactgatgattgggctgacccagaagtggccatctttgtggaaaccaggctggagtgcaatggtgtgatctcagctcactgcaacctccacctccagggttcaagcaattctactgcctcagcctcccgagtagctggcattacaggcgcatgcaaccacgcccagctaattttttgcatttttagtagagacggggtttcaccgtgttggctaggctggtctcaaactcctgatctcaggtcatctgcctgcctcagcctcccaaagtgctgcaatcacaggcatgagccacctggcctgttttttaaaaagcctaagcctgttgaccccaggctccacaatcttcaattttccgagtctcagtttttttttcatgagtaaaatagaggtaatacctacctcacagagattttgtgaagattaaatgaaacagtgtctggaccataagtgcccaatataaagtcatccagagtaaagtcatagggctcaaagtctttccggaagcggcgagccagggtctcctcgtcttccttgctgatctgacactgcctccagtcagacttatcaggaacattaaggatggcttcactggccaggacctccctgcagaaatagcacaaagaagtcaaaatggaaactatcagcctgagctctcctcaacatcacccaaaggaggggactcaggcccacgtaacagcagcacaagcccaatgtcaacaaaacaactatcttggctcttaggactaaagaat

SEQ ID NO: 282740 - DNA, 367 bp, Homo sapiens
aaagatcagagactggatcccatttccagctttgccacttgctatctatgatctagacagatgatttcatctctgagtcttgatttcctcacctatgaaatgcaaataagaacacccaccatacagggtttttgtgaggtacagagataacacagtcaaagtgccatattagctgtgattacaacctgccttaaactgtagttttgtcacctcaactagacatgagtttgcagagtcaggagcctagtcatacccactctgatttaaaattcctctgcctctccttctaggggactcaggcccacgtaacagcagcacaagcccaatgtcaacaaaacaactatcttggctcttaggactaaagaat

SEQ ID NO: 282741 - DNA, 358 bp, Homo sapiens
aattaaaaaaaaaaaaaagctttactacttcctgtggagttcataaaaagttcttccctttgttttagtcatccagagtaaagtcatagggctcaaagtctttccggaagcggcgagccagggtctcctcgtcttccttgctgatctgacactgcctccagtcagacttatcaggaacattaaggatggcttcactggccaggacctccctgcagaaatagcacaaagaagtcaaaatggaaactatcagcctgagctctcctcaacatcacccaaaggaggggactcaggcccacgtaacagcagcacaagcccaatgtcaacaaaacaactatcttggctcttaggactaaagaat

SEQ ID NO: 282742 - DNA, 328 bp, Homo sapiens
aggaagacgttgttggggtccgcagggatgcctccgtcacgcctctcaatgtaccgcgccacgtcctcccggatcagctggatgccggagctgacgctgtaggcccctggactcgggcaggacaggatgggaagtacagatgcctggagcaaaggggaagggaggaggctcatggaccctccctgctcagagttccccccgctctacgtccctctgtgttaaaggtaaaggccctacctgtgctcaggtaccctctcctcccaagccacctggcctcctcactctgcttccctccttagcagttctgccctcctcactgaccaagaca

SEQ ID NO: 282743 - DNA, 1062 bp, Homo sapiens
ctgctgccaccccaccctcaccaacagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagccggcccagcatccagctgcccaggactgggtctctgctgccgcagctctctgacatcaccccctaccagccgggggatctaggcctggtacctcgccaggtccacatcccacccaacccccaggacctcaggctgctgtcatctatcacccgtgtggggaccttccgggcacacagcagccctgagatgcgtgcccctggttctctaaaaaggcttgaaaagtttagtcttcctgaagttcccctacgtcccaagtaggacacagagagaagaacctactccagaaatggactggtccagtcacagtcacccccactttaatccgcaggcagcctggaacagtctagaggagatttgtataaaaagtagataccaagaaaacaatacaaatagaaaaagacgataaataaagaaagataaaggaactaacttaccaaagacacacagaggggggcccgagccgataagaccaccgcgagggggggacccgcaatcgaagaccccagtagaatgggttcaacaagggtgcgctcttccagcagtccagtaatgaaagctgagcgtggcggacgagtgacgtaaaaaacaagaggcgtagcgggacaagatgcggtcctaggtggcgcacatcaggagaagaagagggagccaaccctaaacgcgggggcgggaggtcgctcacatacaatcccgagcatacccatgttgccagccacccggggaagggaaataatacccccatggggggacaaacatcccacaggagtacagtagcgccaacaaggagcgactaaacaaccttcggaataaagtccgaatgccaaaggaaccatatcgccaaggtgagcatattcccggacggaagac

SEQ ID NO: 282744 - DNA, 991 bp, Homo sapiens
tgagacagagtctcactctgtcacccagactggagtgcagtgccacaatctcagctcacagcaacctccgcctcccaggttcaagtgattctcctgcctcagtctcccaagtagcagggattacaggcatgcaccaccatgcctggctactttttgtatttttagtagagacagggtttcaccatgttggccaggctggtctcgaactcctgacgtcaagcaatcccccagcctcggcctcccaaagtgctgggattataggtgtgagccactgcacccggcctccaagccagcatctttaatcttacagatgcgtgcccctggttctctaaaaaggcttgaaaagtttagtcttcctgaagttcccctacgtcccaagtaggacacagagagaagaacctactccagaaatggactggtccagtcacagtcacccccactttaatccgcaggcagcctggaacagtctagaggagatttgtataaaaagtagataccaagaaaacaatacaaatagaaaaagacgataaataaagaaagataaaggaactaacttaccaaagacacacagaggggggcccgagccgataagaccaccgcgagggggggacccgcaatcgaagaccccagtagaatgggttcaacaagggtgcgctcttccagcagtccagtaatgaaagctgagcgtggcggacgagtgacgtaaaaaacaagaggcgtagcgggacaagatgcggtcctaggtggcgcacatcaggagaagaagagggagccaaccctaaacgcgggggcgggaggtcgctcacatacaatcccgagcatacccatgttgccagccacccggggaagggaaataatacccccatggggggacaaacatcccacaggagtacagtagcgccaacaaggagcgactaaacaaccttcggaataaagtccgaatgccaaaggaaccatatcgccaaggtgagcatattcccggacggaagac

SEQ ID NO: 282745 - DNA, 875 bp, Homo sapiens
ctgctgccaccccaccctcaccaacagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagatgcgtgcccctggttctctaaaaaggcttgaaaagtttagtcttcctgaagttcccctacgtcccaagtaggacacagagagaagaacctactccagaaatggactggtccagtcacagtcacccccactttaatccgcaggcagcctggaacagtctagaggagatttgtataaaaagtagataccaagaaaacaatacaaatagaaaaagacgataaataaagaaagataaaggaactaacttaccaaagacacacagaggggggcccgagccgataagaccaccgcgagggggggacccgcaatcgaagaccccagtagaatgggttcaacaagggtgcgctcttccagcagtccagtaatgaaagctgagcgtggcggacgagtgacgtaaaaaacaagaggcgtagcgggacaagatgcggtcctaggtggcgcacatcaggagaagaagagggagccaaccctaaacgcgggggcgggaggtcgctcacatacaatcccgagcatacccatgttgccagccacccggggaagggaaataatacccccatggggggacaaacatcccacaggagtacagtagcgccaacaaggagcgactaaacaaccttcggaataaagtccgaatgccaaaggaaccatatcgccaaggtgagcatattcccggacggaagac

SEQ ID NO: 282746 - DNA, 465 bp, Homo sapiens
ctgctgccaccccaccctcaccaacagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagccggcccagcatccagctgcccaggactgggtctctgctgccgcagctctctgacatcaccccctaccagccgggggatctaggcctggtacctcgccaggtccacatcccacccaacccccaggacctcaggctgctgtcatctatcacccgtgtggggaccttccgggcacacagcagccctgagcgtcccgtgggccccaacgcagaggagcggaaacgcagagcaacgctgcagtggggaaggggcgcgaagaaggggcccagaaac

SEQ ID NO: 282747 - DNA, 477 bp, Homo sapiens
agtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagaggtaagcaagtggccctgtgtggcctcagaggcagccacagagagcagggcaaaggcattcagccatggggacagtgctcggctcaccctgggccagaaacctggctcgccgaaggctctgtgaccctcggccccctccccacagccggcccagcatccagctgcccaggactgggtctctgctgccgcagctctctgacatcaccccctaccagccgggggatctaggcctggtacctcgccaggtccacatcccacccaacccccaggacctcaggctgctgtcatctatcacccgtgtggggaccttccgggcacacagcagccctgag

SEQ ID NO: 282748 - DNA, 772 bp, Homo sapiens
gagctctgggatgactttggtcacagctttcgcagccccagtggaggctgggatgatgttctggtgggcaccccgcccatctcgccaggccttccttgatggcccgtccactgtcttctgggtggccgtgtaggaatggactgtggtcttggggaagagaaggaccaagatgaggccttcatgctcctaagctcccatgcctcttttttccaggactaagttggtggcctaggtgtggaggctggtggggccaccaccacagaccacaggaggggatgtgtgcaggccagggtccagccttgcctgagggttgcacagtgttttaagtgacttctgcactggtgggcctctcctcccgaaaccagtctctccctcttaactccatacagtaagcaaggcccgggaagaagttgggtttccctgccatccttcctgccccagcccctcatcctcaactcaccatcaacccttccacgatcccaaatcgctcgtggatgactttggcgaggggagccaaacagttggtggtgcaggacgcgttgctgaaacagccaaggtgtgcacggacactgtgaggtggtgacctccccaactcagccctcaacctcctcagaggcgccaatgctgactgctgtcagccagcccagaccctttctccatatgctgcccgggacgtggactctgtgactgtgaggcctgcccggctgctttctgcttcccagctctgacaacctcgccatgaaccctcctagaccctcagctcctgcaatag

SEQ ID NO: 282749 - DNA, 538 bp, Homo sapiens
agctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcggctgacaagtttatttaatccctgaacctggatccaaggcatctccctgtagaaaacatcagaccggggcagagattgacaaagcaacccaaagcagcagctgccaacggccgctgtgcccacctcatcagcagctaaagagtataattttaaaaaaagtcacagaagaatgtggagacacttagcaaaacggactctcataaggttccctattttgtcagtaaggaagtaaacaaccgctaaaacaaccctctaacaacagaagaccctcatgagaacaccaggcagcagaagcttctttagcagtaaaagatatctggatattcatattttgttccatgatcttcaacattaaataaataaacttaatattcaagtctcatt

SEQ ID NO: 282750 - DNA, 441 bp, Homo sapiens
tcgcgtcctccccgcgcggcggacagcccgggcgcccttcctctctgcgggactgcagctgacaagtttatttaatccctgaacctggatccaaggcatctccctgtagaaaacatcagaccggggcagagattgacaaagcaacccaaagcagcagctgccaacggccgctgtgcccacctcatcagcagctaaagagtataattttaaaaaaagtcacagaagaatgtggagacacttagcaaaacggactctcataaggttccctattttgtcagtaaggaagtaaacaaccgctaaaacaaccctctaacaacagaagaccctcatgagaacaccaggcagcagaagcttctttagcagtaaaagatatctggatattcatattttgttccatgatcttcaacattaaataaataaacttaatattcaagtctcatt

SEQ ID NO: 282751 - DNA, 426 bp, Homo sapiens
ctatgcttatcagaaaaactttcatttggttcaaggatttttgctgacaagtttatttaatccctgaacctggatccaaggcatctccctgtagaaaacatcagaccggggcagagattgacaaagcaacccaaagcagcagctgccaacggccgctgtgcccacctcatcagcagctaaagagtataattttaaaaaaagtcacagaagaatgtggagacacttagcaaaacggactctcataaggttccctattttgtcagtaaggaagtaaacaaccgctaaaacaaccctctaacaacagaagaccctcatgagaacaccaggcagcagaagcttctttagcagtaaaagatatctggatattcatattttgttccatgatcttcaacattaaataaataaacttaatattcaagtctcatt

SEQ ID NO: 282752 - DNA, 442 bp, Homo sapiens
agctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcggctgacaagtttatttaatccctgaacctggatccaaggcatctccctgtagaaaacatcagaccggggcagagattgacaaagcaacccaaagcagcagctgccaacggccgctgtgcccacctcatcagcagctaaagagtataattttaaaaaaagtcacagaagaatgtggagacacttagcaaaacggactctcataagatttgaggaaactcctaaggtccctccagtgtacaacaatttggtaaaatatactgtgaacagaattaaaatatttgccttttc

SEQ ID NO: 282753 - DNA, 722 bp, Homo sapiens
agctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcggctgacaagtttatttaatccctgaacctggatccaaggcatctccctgtagaaaacatcagaccggggcagagattgacaaagcaacccaaagcagcagctgccaacggccgctgtgcccacctcatcagcagctaaagagtataattttaaaaaaagtcacagaagaatgtggagacacttagcaaaacggactctcataagatttgaggaaactcctaaggtccctccagtgtacaacaatttggaggctgatggactacatccatggggtactttgtcctctggcttccaattagattcagacaacaggaagcatcaacagctaatgggagacgaagaggaaaaattggggtacctattcccctagattactccctgctgattgctgcagaggggcttcatccttgccctggtttctggaaaacactctttcattgcccatgcaggcctaggagtgatgatgcctcactggatggcaaagtctcttattggtttccctaaatcttactcacaacttgtagatactccctctattaaatccttttcagttacccaaattgagtgt

SEQ ID NO: 282754 - DNA, 745 bp, Homo sapiens
agctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcggctgacaagtttatttaatccctgaacctggatccaaggcatctccctgtagaaaacatcagaccggggcagagattgacaaagcaacccaaagcagcagctgccaacggccgctgtgcccacctcatcagcagctaaagagtataattttaaaaaaagtcacagaagaatgtggagacacttagcaaaacggactctcataagagtgttcgatggtgctgctactaatgaaagatttgaggaaactcctaaggtccctccagtgtacaacaatttggaacttccattttctcaacaactgctcttccaagatgctgcctcatttcagagccatgttttactcatgagctggtcctgtccagaaaacagccaatgctcattcccgacactttcttgtcactgctcttttctgttccctattttgtcagtaaggaagtaaacaaccgctaaaacaaccctctaacaacagaagaccctcatgagaacaccaggcagcagaagcttctttagcagtaaaagatatctggatattcatattttgttccatgatcttcaacattaaataaataaacttaatattcaagtctcatt

SEQ ID NO: 282755 - DNA, 1716 bp, Homo sapiens
ggcctcctgctgcggaggaagagggggaagaggccgcgcgggagggacttctgacacgcgccactgtttttgttttcaaacaggggtacttaaccgaaactagcaatcccaggcggtacaaggccctccatcgtaggcaaagcactacctgaatgtagatttgggccatacgttggaaaataagacatgagagtatgctccgatcaacttttactgttcactggacaactattttgggaatttgcagacctataaagcccatctataaatctcaagcatgtccactttcagagaagagaaatgctgacaaccatttagtctctgaggacaacacttttaaagagccagaaaggtacatttcctcttcatgtgttctcacttccatcctttacctcggtgaaaagacgttttccttccgtacactcatcagtccaagagggatgaagcttgtggaaattttgcagcagccttccctgaccatggtggcctgaagtgcaccttttatacaggactccatcataggactggagagagattggatgtcagagtgattgatgtgctcctactggaagaaggcaaacatccatatgtgaactgcctgtggggtttccaaggaaaggaacggcaggcagcctctatgagcttaaagaagataactgggactttagtcctataacctcaaggaacagtattctgtgaaccatctgagaagcttggaagaggaccccaaactccaaataagaagctcagtgtgtctgacaccttgactgcaggcttgggaggtcctgagcagaagatccagttcaacagtgcctggactcctgatccacaaaaactgataacaaatatttattgttttaagatgctaagtttgtagtcattttttatacagcaacagaaaactaaacacacacataaacagttataagtgctcactgtatatgaggcttttcattaataatctatattttataatagaattagaatatagatctgtgaagctgaagacactcaatccttgctagatttaaatcaggaaaatcagctgagaatcattccttgatagaacctggaaaacaagaccctatgagagaccctgggaattacattaaattcactgtggttcccagtgtcactgaagaggttttcctttcatagtcaggtagtcaccatactgttaagcatttgaacacatgggcaacttccagaatagttatgacattgatataccaatctccaaaattcctagaataccatgttttcatggttgaccttcaaatcagtcagttctttgtaacattgagccataaagatagggcaaatacttaatgttttacatatattcagagattgaccctcaaaatacagcccagagaaactcaaaagaattaactctatttcttcaaattgtgtgacgccaccaaggccagatgacttcagcattgggaaggcaatatccagctgtcatcttcttgatcctcatatgctactactagcatctagcatttactgagcagatagttttattgtccagtttttaaagataagaaaattgaggtattaggaaagttaagttggttgcctagggaaacacgaagatatagcccagattcactcccaggcaggcagatgccagtgtctgctctctttaccaccaaaatatcctgctacatgtacaatttcaataaatatctggacttactggaacaaaacaaa

SEQ ID NO: 282756 - DNA, 1761 bp, Homo sapiens
cgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggggtacttaaccgaaactagcaatcccaggcggtacaaggccctccatcgtaggcaaagcactacctgaatgtagatttgggccatacgttggaaaataagacatgagagtatgctccgatcaacttttactgttcactggacaactattttgggaatttgcagacctataaagcccatctataaatctcaagcatgtccactttcagagaagagaaatgctgacaaccatttagtctctgaggacaacacttttaaagtgtaacaatgtggcatccagagcttatccagatgagcggagagcaaatgaatttccttctgctcccctgttgaagaggagagaaaaattcttcaagctttatacaggactccatcataggactggagagagattggatgtcagagtgattgatgtgctcctactggaagaaggcaaacatccatatgtgaactgcctgtggggtttccaaggaaaggaacggcaggcagcctctatgagcttaaagaagataactgggactttagtcctataacctcaaggaacagtattctgtgaaccatctgagaagcttggaagaggaccccaaactccaaataagaagctcagtgtgtctgacaccttgactgcaggcttgggaggtcctgagcagaagatccagttcaacagtgcctggactcctgatccacaaaaactgataacaaatatttattgttttaagatgctaagtttgtagtcattttttatacagcaacagaaaactaaacacacacataaacagttataagtgctcactgtatatgaggcttttcattaataatctatattttataatagaattagaatatagatctgtgaagctgaagacactcaatccttgctagatttaaatcaggaaaatcagctgagaatcattccttgatagaacctggaaaacaagaccctatgagagaccctgggaattacattaaattcactgtggttcccagtgtcactgaagaggttttcctttcatagtcaggtagtcaccatactgttaagcatttgaacacatgggcaacttccagaatagttatgacattgatataccaatctccaaaattcctagaataccatgttttcatggttgaccttcaaatcagtcagttctttgtaacattgagccataaagatagggcaaatacttaatgttttacatatattcagagattgaccctcaaaatacagcccagagaaactcaaaagaattaactctatttcttcaaattgtgtgacgccaccaaggccagatgacttcagcattgggaaggcaatatccagctgtcatcttcttgatcctcatatgctactactagcatctagcatttactgagcagatagttttattgtccagtttttaaagataagaaaattgaggtattaggaaagttaagttggttgcctagggaaacacgaagatatagcccagattcactcccaggcaggcagatgccagtgtctgctctctttaccaccaaaatatcctgctacatgtacaatttcaataaatatctggacttactggaacaaaacaaa

SEQ ID NO: 282757 - DNA, 1900 bp, Homo sapiens
ggtgggtggcgcggacctcgggtccccagccatcggcgctctcccggggccctctgacctcgctccttaaaggaggagggtccgtggcaacggtcctcctcggccaggcgctctcgggacgcgggggtgaggagtgagcgccgtggcccaccctactctccgagcggggacggagtgggcgacaccgcgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggggtacttaaccgaaactagcaatcccaggcggtacaaggccctccatcgtaggcaaagcactacctgaatgtagatttgggccatacgttggaaaataagacatgagagtatgctccgatcaacttttactgttcactggacaactattttgggaatttgcagacctataaagcccatctataaatctcaagcatgtccactttcagagaagagaaatgctgacaaccatttagtctctgaggacaacacttttaaagtgtaacaatgtggcatccagagcttatccagatgagcggagagcaaatgaatttccttctgctcccctgttgaagaggagagaaaaattcttcaagctttatacaggactccatcataggactggagagagattggatgtcagagtgattgatgtgctcctactggaagaaggcaaacatccatatgtgaactgcctgtggggtttccaaggaaaggaacggcaggcagcctctatgagcttaaagaagataactgggactttagtcctataacctcaaggaacagtattctgtgaaccatctgagaagcttggaagaggaccccaaactccaaataagaagctcagtgtgtctgacaccttgactgcaggcttgggaggtcctgagcagaagatccagttcaacagtgcctggactcctgatccacaaaaactgataacaaatatttattgttttaagatgctaagtttgtagtcattttttatacagcaacagaaaactaaacacacacataaacagttataagtgctcactgtatatgaggcttttcattaataatctatattttataatagaattagaatatagatctgtgaagctgaagacactcaatccttgctagatttaaatcaggaaaatcagctgagaatcattccttgatagaacctggaaaacaagaccctatgagagaccctgggaattacattaaattcactgtggttcccagtgtcactgaagaggttttcctttcatagtcaggtagtcaccatactgttaagcatttgaacacatgggcaacttccagaatagttatgacattgatataccaatctccaaaattcctagaataccatgttttcatggttgaccttcaaatcagtcagttctttgtaacattgagccataaagatagggcaaatacttaatgttttacatatattcagagattgaccctcaaaatacagcccagagaaactcaaaagaattaactctatttcttcaaattgtgtgacgccaccaaggccagatgacttcagcattgggaaggcaatatccagctgtcatcttcttgatcctcatatgctactactagcatctagcatttactgagcagatagttttattgtccagtttttaaagataagaaaattgaggtattaggaaagttaagttggttgcctagggaaacacgaagatatagcccagattcactcccaggcaggcagatgccagtgtctgctctctttaccaccaaaatatcctgctacatgtacaatttcaataaatatctggacttactggaacaaaacaaa

SEQ ID NO: 282758 - DNA, 706 bp, Homo sapiens
ggtgggtggcgcggacctcgggtccccagccatcggcgctctcccggggccctctgacctcgctccttaaaggaggagggtccgtggcaacggtcctcctcggccaggcgctctcgggacgcgggggtgaggagtgagcgccgtggcccaccctactctccgagcggggacggagtgggcgacaccgcgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggggtacttaaccgaaactagcaatcccaggcggtacaaggccctccatcgtaggcaaagcactacctgaatgtagatttgggccatacgttggaaaataagacatgagagtatgctccgatcaacttttactgttcactggacaactattttgggaatttgcagacctataaagcccatctataaatctcaagcatgtccactttcagagaagagaaatgctgacaaccatttagtctctgaggacaacacttttaaagtgtaacaatgtggcatccagagcttatccagatgagcggagagcaaatgaatttccttctgctcccctgttgaagaggagagaaaaattcttcaagctggagaactacttgatcttaaa

SEQ ID NO: 282759 - DNA, 418 bp, Homo sapiens
atcccgccccggcacccgcaggcccctcgggtcttcgcagcccgcttcttcctctcaggccatcgcaggcctccctgccgcccgtgtgcccgcctcggcggtctcacatcgcgctcaccgttcaccagcgccggggtcttctccacaaggttacggacaaattgggccatggttctggaatggagagtccgtcgccccgaaccgccggctgaatgtcacccgccggaaggacccgctgcaggaccccgtcccacttccaaggttcatttcctgttgagcagttagagcatgtgcattatttcctcacatgacatcaacagtgcagcatcagcctctggcatgtaaaggcacccagtagacttatgctctgtgcaatggctgcttagcaaccaccatcaaataaagtaatgaagctttt

SEQ ID NO: 282760 - DNA, 831 bp, Homo sapiens
tgcagctattttaggttctctaacttcatcgtagtttatagggtaagtaaagggaaggggaaagtgattggtgtggttgtctcccataagaactgatttttttctactgaagcatgtataaagtttatatatgactttttatatttgtttaataaaaattttacaggaactaaatttgattatcaatatgaagtttttctttaatttcagatttcaactattgcagaaagtgaagattcacaggagtcagtggatagtgtaactgattcccaaaagcgaagggaaattctttcaaggaggccttcctacaggtatggaatttaatagttagaatcaaagatgtggaggaagtcttaggtagttgcagataaagagatgtcagaagaccagttagttgttcacgtcagttccttatagattacttttcttcatcttgagttatttgtctcaaataaagtggaagcttatcctacagaataagaagagcacttgttactctcaccagtcctaattttttttttttctgtttctgtttctgtagactgtgctggctgtctttctgttaaaagtttggaatacagttgataaggttatagcattttttagttataagccaactctgaggctctgttatttatctacttagtaacacattgcaaaccattttttatgccatggtacttaacagatagctattaatttaataattgtctcagggagatgctttactaacatcccctaattttagcagtagcttactgtaatttttgtgttcagttatagatgttgcctagtccatgccttgcctccaaggtgaaccaaaaccatttt

SEQ ID NO: 282761 - DNA, 860 bp, Homo sapiens
agctgctggttatcccactctgccatgtgtgctgtttctctttgcttttgccactactccactctgtgcttgaaattctgtgactcttccctgtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggtatggaatttaatagttagaatcaaagatgtggaggaagtcttaggtagttgcagataaagagatgtcagaagaccagttagttgttcacgtcagttccttatagattacttttcttcatcttgagttatttgtctcaaataaagtggaagcttatcctacagaataagaagagcacttgttactctcaccagtcctaattttttttttttctgtttctgtttctgtagactgtgctggctgtctttctgttaaaagtttggaatacagttgataaggttatagcattttttagttataagccaactctgaggctctgttatttatctacttagtaacacattgcaaaccattttttatgccatggtacttaacagatagctattaatttaataattgtctcagggagatgctttactaacatcccctaattttagcagtagcttactgtaatttttgtgttcagttatagatgttgcctagtccatgccttgcctccaaggtgaaccaaaaccatttt

SEQ ID NO: 282762 - DNA, 556 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccagttcaagaccagcctgggcaacatagcaagaccctgtctctacaaaaaaattaaaaattagctgggagtggtagtgcatgcctgcaatcccagctaactcaggaggttgagtctggaggatcccttgagcccatgagtttgaggctgcagtgggctgtgatcgcaccactgcactccagcctcggtgagtgagtgagatcctgtctcttaaaaaaaaaaaa

SEQ ID NO: 282763 - DNA, 2634 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactctt

SEQ ID NO: 282764 - DNA, 2101 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttca

SEQ ID NO: 282765 - DNA, 2880 bp, Homo sapiens
gcactgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282766 - DNA, 2943 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282767 - DNA, 3174 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatgagtctacttgaaattttttaatatgaatttaccaatatcaaaggaagacactgaggactatactctatctaggaagatcatccaagctgtgccccacttaccttttagacttaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282768 - DNA, 1345 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggattaatttatttaccaaactagcagtggacagtatattgccattacccagggaggagcaatacagctggagtcagtggatagtgtaactga

SEQ ID NO: 282769 - DNA, 1481 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacaggtacaaatactgcatttacttagattgttatgtgttaagtgtgtcttcacattctgctggatgtgtatctttacatctactggtaataggatctttgcattgaattttttttttccagcagaattaatggatcttgctaaattttctttatttaataagctgcacttataagatagctgtatgattatgggtcaatctttgatcgtggagtagttttctttcatgcagtttccccacaggagatttaatgcacaacttccctatgtctgcactccaaccagttagccaggttatttaaaaatggtttcttttcatgtatagtattgttcaagaagatcaagagtttcatatatgtatattaactgtgtgttaaattttatctatattaaatttacttgatataaagtaaaaatatggtgg

SEQ ID NO: 282770 - DNA, 1363 bp, Homo sapiens
gcttttttagagggtatgtctcttaacaactttacataattcacaatgagaatgtgacaacatgtcaatttggcaatcaacacttcttcattgcaccttactaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282771 - DNA, 398 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccgccgccgcctaggtgccggtgggggatggaggaggaagaaggcgacagttgagggcagaggaggtgaaggtgcctgctgccttcccggtggcttcggtgcctgccatgcccgcttcgcaaggggaagagctgcaacgtctgacctactcttctctccactctttgtgcaataaagttcgaaaccc

SEQ ID NO: 282772 - DNA, 378 bp, Homo sapiens
cttcatacatcatacagtaacacacttatgtgcaccattggtgctgagctgctggttatcccactctgccatgtgtgctgtttctctttgcttttgccactactccactctgtgcttgaaattctgtgactcttccctgtaagtaataataacaagtctaacttttttcttttgttttaaattcacattcttccctgatagcctccccttctcttaggttgggtagagtaattctcagtgtgtccatttttcttttagcaaacctcattactaaactgaattgtattgtgtctcttttccccattccttcgcatacatacccccaataatttatttgaggtcagagacccctatctttctcacttttgtagtttcagt

SEQ ID NO: 282773 - DNA, 2996 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282774 - DNA, 3038 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282775 - DNA, 2752 bp, Homo sapiens
agctgctggttatcccactctgccatgtgtgctgtttctctttgcttttgccactactccactctgtgcttgaaattctgtgactcttccctgtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282776 - DNA, 2985 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282777 - DNA, 3216 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatgagtctacttgaaattttttaatatgaatttaccaatatcaaaggaagacactgaggactatactctatctaggaagatcatccaagctgtgccccacttaccttttagacttaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaa

SEQ ID NO: 282778 - DNA, 1314 bp, Homo sapiens
gcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagatgaagtcttgctctgtcacccaggcaggagtgcaatggtgcaatctcagctcactgcagcctccacctcctgggttcaagcaattctcctgcctcaacctcccgagtagctgggattacaggtgcccaccaccacgcctggctaatttttgtattagtagagacatgatttcactattttggccaggctggtctcgaactcttgaccttgtgatccaccctcctcggacttccaaagtgctgggattacagg

SEQ ID NO: 282779 - DNA, 2424 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtacggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcaggtaaaaatttctcttggctttagatgacatttagccctaagattggaagaatggttcgttaagtttagagtaattcacttcaggaagttacttggttcccataatagcttccagtattcattgatttatttctggctttcccagactagaaattttgtaaagagtcatgggggaagctagggctaaccagaaaataaaataaaaataatgggataaaaaatcggaactactgttttccccctagtcggagcacatccgg

SEQ ID NO: 282780 - DNA, 1473 bp, Homo sapiens
ggattattaattactcttaacaattatatgtgatctgatcaacagtcatctgagtctgtctttagtctttcccttatatttttttcttttgattctaggtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttttacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactgacttcattgcagtagtgtttaggtaatacttctccagaaactagtgaaatcaaaccacagtaattttatctgctgagtatatatcattgtaatcaattacttccaaatgtctttatcaataaacaaatatactaaaaga

SEQ ID NO: 282781 - DNA, 2767 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtacggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagctt

SEQ ID NO: 282782 - DNA, 1603 bp, Homo sapiens
tagagacaaggtttcaccgtgttggccaggatggtcttgatctcctgaccttatgatccacccacctcggcctcccaaagtgctgggattacagctgtgagccactgtgcccggcccaagaaaccctttttaaggaagtgacaactgaacccaaaacatgaaggagcagccagccagccaaagggtccagagaagagtatttcagatagagggaacaaaatctctgaggtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttttacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactgacttcattgcagtagtgtttaggtaatacttctccagaaactagtgaaatcaaaccacagtaattttatctgctgagtatatatcattgtaatcaattacttccaaatgtctttatcaataaacaaatatactaaaaga

SEQ ID NO: 282783 - DNA, 2185 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtacggacacctgaatcatttattgtggttgaggaagctggtgagtacagttcagtaagtataaaataaagtgtgggatgggcatggtggctcatgcctttaattccagcactttgggaagctgatgtgtgagccttgagtttgaggagttcattgaggccaggagttcaagactagcctgcgcaacatagtgagacctcatctctaattttttttttt

SEQ ID NO: 282784 - DNA, 642 bp, Homo sapiens
tacaagactatgaaaaagtagcaataatttattaacaaaatattgaaaggaatattttcccctttaatttgatagataattcctgagaacttcagtgttttcagtttgatccgggaaatgcggacacagaggccttcattagttcaaacgcaggtatgaactatagtgaatggatcagaacatgtgtctgagtcttgctccatctgtttaatggtgaggcatccaaaaacagctgactgctcagatataacaccaatttaccattacgtgctctagagtccattgccattttctctaactctgaatatcccaatatttttcctgtatcccttgtcctgggtcaaattcctttcattccttattttactgtctgttcagaaaatattaagataccaatgtaatattacttacttccttacaaaggatgttgtaaaagtattcaacaaactgacttgtggacttgaaatagctaggtcatgttaatttgaaattttgtagtgataaaattcatctctgaaagcatagaaaatcagggatttgtaatttctacccaggatgtggtaacagaatatggagaattcagtctatgtgctcgttttaggaaacactgaaaaataaaaataaaaaccatattcctattac

SEQ ID NO: 282785 - DNA, 3768 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtacggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttttacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactgacttcattgcagtagtgtttaggtaatacttctccagaaactagtgaaatcaaaccacagtaattttatctgctgagtatatatcattgtaatcaattacttccaaatgtctttatcaataaacaaatatactaaaaga

SEQ ID NO: 282786 - DNA, 1955 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttttacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactgacttcattgcagtagtgtttaggtaatacttctccagaaactagtgaaatcaaaccacagtaattttatctgctgagtatatatcattgtaatcaattacttccaaatgtctttatcaataaacaaatatactaaaaga

SEQ ID NO: 282787 - DNA, 498 bp, Homo sapiens
gctcgcgtggtcactttccactcattggacgtggtagcagcaacgagagctccaaaccctccgacaccagacaccagagcccagatctgcgccctggacatgtcgcgccgccttctccagtgacactgtccggtcagaacgctttggtggtctaggcatgcagccgatagagaacactttgacaagcgtcacagccagcggatgtggcctttgaacccctcagaagacctcagctcaaaggttactacgtcaccgaatctctccctgaccaccacgctgtgaagtagcctgggaagaaaggccatctcagctcttccagccgtcctacctgaagcctgaacatgtgagtgaaaccactgtggactcccagcttttgctgagccctcaggtttctgcagctgtaggagtgaattcacgtgaggcgagtggcagagctacccgatcaaccttcacaattgtgctaaataataaataagtaaacgatgactgtttttaatc

SEQ ID NO: 282788 - DNA, 3093 bp, Homo sapiens
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccactatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagagaccg

SEQ ID NO: 282789 - DNA, 1437 bp, Homo sapiens
ggaggacgttagatgtggcggtaaagagggtgggcttgaggcaggccattggggtgctgatcctggcctcggcccttacccctgtggccttggcaagccctcacccttccttgtctcaggttcctcctctgtagaatggatacagcaccagccccagcctcagagggttgttgtaaggatttggtgcaattccacatggaaagcccttgagaagagtggctggtgtgtagtgagtgctcagtaaatgtggactctcattaccattgtgagtggcctgtaaggatccccattttacagaggaggaaactgaggtctggccaggggaggtggtgttcccaggtcactcagagagtttgaggggagctggggctacagcttagtttcccactttgctggccaggatgttttgattccagctgccccagcgacacctgaactccacgttagggctgcaggaactccttgggccctgggggatggagagggggcaggacggagggtgggggtagctggttgcctatcccgacttcctccccaggatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagccagggatggccggagggctgcgggctccactatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagagaccg

SEQ ID NO: 282790 - DNA, 349 bp, Homo sapiens
  misc_feature (313)..(313): n is a, c, g, or t
actcaccaccagcctcgtgcccactgggctcccaccccttcccaggaccctcccctagcttggtccccctgagcttggcttcccaccctgcaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcgaatgttnagggatccttagagtaacctgcagcatcagctgctg

SEQ ID NO: 282791 - DNA, 308 bp, Homo sapiens
ctgactctacaggatcttcattgtgaactgggcttccaactccagcataaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcggtgagcagctgccagctgtgca

SEQ ID NO: 282792 - DNA, 3246 bp, Homo sapiens
atttggagtcaggcctggctgttgctcaggtgaccagcttgtgtctctgggagggcgctgctttccccggccacccggcgcgatgatccagaatgtcggaaatcacctgcgacggctctctttggaaggagaaattgcagaacccctgggctggtttattatcagcagcaatctccaaacaagccccaggggctgtcagatcccccacgggctggctgtgtagagtggaatcaccttcagcaagtgtcggcctctggaattctattcgggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccactatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagagaccg

SEQ ID NO: 282793 - DNA, 2639 bp, Homo sapiens
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagccagggatggccggagggctgcgggctccactatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagagaccg

SEQ ID NO: 282794 - DNA, 6370 bp, Homo sapiens
  misc_feature (3625)..(3625): n is a, c, g, or t
  misc_feature (4427)..(4427): n is a, c, g, or t
  misc_feature (4459)..(4459): n is a, c, g, or t
  misc_feature (4483)..(4484): n is a, c, g, or t
  misc_feature (4498)..(4499): n is a, c, g, or t
  misc_feature (4509)..(4509): n is a, c, g, or t
  misc_feature (4513)..(4513): n is a, c, g, or t
  misc_feature (4553)..(4553): n is a, c, g, or t
  misc_feature (4562)..(4562): n is a, c, g, or t
  misc_feature (4581)..(4581): n is a, c, g, or t
  misc_feature (4594)..(4594): n is a, c, g, or t
  misc_feature (4605)..(4605): n is a, c, g, or t
  misc_feature (4615)..(4615): n is a, c, g, or t
  misc_feature (4635)..(4635): n is a, c, g, or t
  misc_feature (4639)..(4639): n is a, c, g, or t
  misc_feature (4843)..(4844): n is a, c, g, or t
  misc_feature (4912)..(4912): n is a, c, g, or t
  misc_feature (4943)..(4943): n is a, c, g, or t
  misc_feature (5221)..(5221): n is a, c, g, or t
  misc_feature (5234)..(5234): n is a, c, g, or t
  misc_feature (5321)..(5321): n is a, c, g, or t
  misc_feature (5560)..(5560): n is a, c, g, or t
  misc_feature (5883)..(5883): n is a, c, g, or t
  misc_feature (5887)..(5887): n is a, c, g, or t
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttnaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagnggtgggcgggtcttttgagttcaggagttcangagcagcctggccaacatggtgannccccttctctactnnaaatatgaanattntccgggcatggtggtgtgcctctgtactttcagctactcnggaagctgnggcacaagaattgctggancatgggaggtggnggctgcagtgngctgagatcntgccactgcactccagcccnggcnatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtnntcacagctgcttgggaggctgaggcaggagaattggttgaacccaggaggcagaggttacagtgagcngagatcgtgccactgcattccagccggggtnagagagcgagactctgcctcaaaaaaagaaggcttagtgtgcaactcatcagagttgcacagggcagagaaagaatgggaaaaaaacaatttctagaaaacttttcgaattttctgatcaacaccaaatattccaaataggaaaaatacaaaaaaatccatacctatatgtggcataatatgattgtagagcaccaaagtaaaagatcttattttttattaaaattaaaaaaaaattaaaatagagggtctcactatgctgcccaggctggtcttganctcctggcttcangctatcctcccaccatggcatcctaaagtgctgggattgcaggcatgagctgctgcatctggcccaaagtaaaagatcttagaagcngccagaaaaaatagatttgggctgggcatgaatagattgatcaccaaaaaggtggcagactaacttctcgacagaatccacagaagccagaaggcagtggaacattagctttgatgtactaaaataaaataccacgctaggctcctacatacagtgaaaatgttttgagaatgagaattataattttttggcaaacaaaactaaaggagtttacaactaagaaactcttttgtgagacngccttgctctgttgcccaggctggagtgcagtgacgaaatctcagctcactgcaacctcggcctcccgggttcaggcaattcttgtgtctcagccttccaagtagctgggattacagatgtgcgccaccaggcccagctactttttatatttttagtggagatggggtttcactgtgttggccaggctggtctcaaactcctgacttcaagtgatctgcccgccttggcctgctaaagtgctgggattacaggcatgagcgactgtgcctctccagtccctgtgtttttttttgtttttggaggttttatttgtttgtttttngagncactttcactgtgttgcccaggcctgtctgttggcctcaagtgatcctcctgccttggatctcccagggtgctgggattacaggtgtgaaccactgtgctcagcccattttttatttgtttcttgaaggaaggtagcagtattaattaattttggactttgctcactaaagtttgaatgttaagaatagatgtatacagtctggatgcagtggtgcatgcttgtaattttagcactttggggggctgaagcgggaggatcgcttgggctcaagagtttgagaccagcctgggcaacatggtgaaaccttgtctctacaaaaaaattttaaaaaattagccagacatgatggcatgcacctataatcccagctacttgggaggctgaggtgggaggattgcttgagtccagggaggtcgaggctgcagtgagccatgatcacaccactgcactccagcctgggtgacagagtgatactgtctca

SEQ ID NO: 282795 - DNA, 852 bp, Homo sapiens
ggggacctcggaggcctgtttctgagcccctccccgcggactcgctccccggacgcccccagcgggctcctctggcctcggccctgcacgccgccggggcggagcctcccatcctttggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagatgtaggacaagtggtgaatatcaaggccaacggagaacaagaggcctaacaaaatccagacatgggaaagtgggcaataccaaggtgaggcaacaagaaggaccatggagcatctgagaaagcaagaggaaactgtgatgcaaggcctaagagccaccattacgagaccccagccagaagagaatcacacaagggtagacagcatgaaaggaaaaatcaacgcaagaagaacagagaaaacacagaagacagactgagaagcaacaagatggagtgaacggcatggaacagaccagagggacaatgacagcctataggaaaacactacacagaccacacaaccaaggggaaacaccagggaccaaaaatgaccgaccaaaacaagggaaagaaacaaggaaaaaacaaaagaacagaaaagcacggaaagagggcacagcatagaagaaagaac

SEQ ID NO: 282796 - DNA, 2966 bp, Homo sapiens
ggggacctcggaggcctgtttctgagcccctccccgcggactcgctccccggacgcccccagcgggctcctctggcctcggccctgcacgccgccggggcggagcctcccatcctttggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccactatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagagaccg

SEQ ID NO: 282797 - DNA, 5826 bp, Homo sapiens
gctttgcccagtagttggaaagtgaactcgactcgtgatggttctcctgtcactttggttgatagcagccgctctggtagaggttaggacttcagctgatggacaagctggtaatgaagaaatggtgcaaatagatttaccaataaagagatatagagagtatgagctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggaaaacagagcctttgcagactaactgtgcttatgttggtgacatcgtggacattccaggaacctctgttgccatcagcaactgtgatggtctggctggaatgataaaaagtgataatgaagagtatttcattgaacccttggaaagaggtaaacagatggaggaagaaaaaggaaggattcatgttgtctacaagagatcagctgtagaacaggctcccatagacatgtccaaagacttccactacagagagtcggacctggaaggccttgatgatctaggtactgtttatggcaacatccaccagcagctgaatgaaacaatgagacgccgcagacacgcgggagaaaacgattacaatatcgaggtactgctgggagtggatgactctgtggtccgtttccatggcaaagagcacgtccaaaactacctcctgaccctaatgaacattgtgaatgaaatttaccatgatgagtccctcggagtgcatataaatgtggtcctggtgcgcatgataatgctgggatatgcaaagtccatcagcctcatagaaaggggaaacccatccagaagcttggagaatgtgtgtcgctgggcgtcccaacagcaaagatctgatctcaaccactctgaacaccatgaccatgcaatttttttaaccaggcaagactttggacctgctggaatgcaaggatatgctccagtcaccggcatgtgtcatccagtgagaagttgtaccctgaatcatgaggatggtttttcatctgcttttgtagtagcccatgaaacgggccatgtgttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgttccgaacctttgacccatgtaaacagctgtggtgtagccatcctgataatccctacttttgtaagactaaaaagggacctccacttgatgggactgaatgtgctgctggaaaatggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgtttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgaatcaacaatgtgatacgtaaattatagaaaaagaaaagaaacacaaaagctatagatatacagatatcagcttacctattgccttctatacttataatttaaaggattggtgtcttagtacacttgtggtcacagggatcaacgaatagtaaataatgaactcgtgcaagacaaaactgaaaccctctttccaggacctcagtaggcaccgttgaggtgtcctttgtttttgtgtgtgtgtgttcttttttaattttcgcattgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcaggttcaagaaagcatatgtcgatggttgagatatttattttccatatggttcatgttcaaatgttcacaaccacaatgcatctgactgcaataatgtgctaataatttatgtcagtagtcaccttgctcacagcaaagccagaaatgctctctccagggagtagatgtaaagtacttgtacatagaattcagaactgaagatatttattaaaagttgatttttttttcttgatagtatttttatgtactaaatatttacactaatatcaattacatattttggtaaactagagagacataattagagatgcatgctttgttctgtgcatagagacctttaagcaaactactacagccaactcaaaagctaaaactgaacaaatttgatgttatgcaaacatcttgcatttttagtagttgatattaagttgatgacttgtttcccttcaaggaaacattaaattgtatggactcagctagctgttcaatgaaattgtgaattagaaacatttttaaaagtttttgaaagagataagtgcatcatgaattacatgtacatgagaggagatagtgatatcagcataatgattttgaggtcagtacctgagctgtctaaaaatatattatacaaactaaaatgtagatgaattaacctctcaaagcacagaatgtgcaagaacttttgcattttaatcgttgtaaactaacagcttaaactattgactctatacctctaaagaattgctgctactttgtgcaagaactttgaaggtcaaattaggcaaattccagatagtaaaacaatccctaagccttaagtcttttttttttcctaaaaattcccatagaataaaattctctctagtttacttgtgtgtgcatacatctcatccacaggggaagataaagatggtcacacaaacagtttccataaagatgtacatattcattatacttctgacctttgggctttcttttctactaagctaaaaattcctttttatcaaagtgtacactactgatgctgtttgttgtactgagagcacgtaccaataaaaatgttaacaaaatataaaac

SEQ ID NO: 282798 - DNA, 827 bp, Homo sapiens
ctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggaaaacagagcctttgcagactaactgtgcttatgttggtgacatcgtggacattccaggaacctctgttgccatcagcaactgtgatggtctggtaagactccttctgttttgtgcgtatgtttgcaggtgctgggagtgcagccatggcttctgcatagtttggaaggtggaggtggaaaggaggcttcattgttatgttacattttaagttcagaaaaagacactagaaagcattttgctgtcaaagatatgcattttggcttaatttgtgacaattttgtttcttggaataatgcgaagacgacattattccaagaaacaaaagtcaaatattttagcatttttttttgttaatgtttttccttgtattacattggaagattttatttccttattttgttcaaagtattctgaaaactttccaaagaagcatagattccttcaaaatgaccgtattttactccttatgtggaaactttggatatcttcgtaaagaaagtattttgaaagtgttctttagcttcctcacagaatgctaatgtg

SEQ ID NO: 282799 - DNA, 4012 bp, Homo sapiens
atggttactcacagtttaagctttgccagcacgaaccccatggactcttgatccctatgtggtaacttaggaaacttggtgcttataggagtaagttctcctgggtttctaagaataaggcttaaataccctttctctaaagagccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgtttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgaatcaacaatgtgatacgtaaattatagaaaaagaaaagaaacacaaaagctatagatatacagatatcagcttacctattgccttctatacttataatttaaaggattggtgtcttagtacacttgtggtcacagggatcaacgaatagtaaataatgaactcgtgcaagacaaaactgaaaccctctttccaggacctcagtaggcaccgttgaggtgtcctttgtttttgtgtgtgtgtgttcttttttaattttcgcattgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcaggttcaagaaagcatatgtcgatggttgagatatttattttccatatggttcatgttcaaatgttcacaaccacaatgcatctgactgcaataatgtgctaataatttatgtcagtagtcaccttgctcacagcaaagccagaaatgctctctccagggagtagatgtaaagtacttgtacatagaattcagaactgaagatatttattaaaagttgatttttttttcttgatagtatttttatgtactaaatatttacactaatatcaattacatattttggtaaactagagagacataattagagatgcatgctttgttctgtgcatagagacctttaagcaaactactacagccaactcaaaagctaaaactgaacaaatttgatgttatgcaaacatcttgcatttttagtagttgatattaagttgatgacttgtttcccttcaaggaaacattaaattgtatggactcagctagctgttcaatgaaattgtgaattagaaacatttttaaaagtttttgaaagagataagtgcatcatgaattacatgtacatgagaggagatagtgatatcagcataatgattttgaggtcagtacctgagctgtctaaaaatatattatacaaactaaaatgtagatgaattaacctctcaaagcacagaatgtgcaagaacttttgcattttaatcgttgtaaactaacagcttaaactattgactctatacctctaaagaattgctgctactttgtgcaagaactttgaaggtcaaattaggcaaattccagatagtaaaacaatccctaagccttaagtcttttttttttcctaaaaattcccatagaataaaattctctctagtttacttgtgtgtgcatacatctcatccacaggggaagataaagatggtcacacaaacagtttccataaagatgtacatattcattatacttctgacctttgggctttcttttctactaagctaaaaattcctttttatcaaagtgtacactactgatgctgtttgttgtactgagagcacgtaccaataaaaatgttaacaaaatataaaac

SEQ ID NO: 282800 - DNA, 599 bp, Homo sapiens
gaagttggaagaggcaaggaaggatttgagcctagagcctttggaaggagcatggccctgttggttctggcctccagaactgcaagaaaatacatttttgttgttttaaaccacccagttcatggtaatttgtaacaccagctacaagaaattaacacaaggctgatgtgactttccatcaggagagagacagccccaggtgagacctgcctgcctcattgtctgacagctttcccagcctcctccaggctcccctccgttttctcttatacgcattcccccaataaacttcctgtacatttaataccatctcagtgtctgctcccaggaggaccctaactgacacactggggcatttagcctccaattccttttctcccttggctgagatctgttccaggaagtatctccaggacactccagcctgttgcacaggccaaagaaaagccctcaggcagaggagcaaatacttgcaagaggacaccagtggcaagaacagggacatggtgagacttcgacatcattggctacagtagtactagtcactcttgactgtggtttatgttgtttcaataaagtagctttccttctcaaaaaca

SEQ ID NO: 282801 - DNA, 725 bp, Homo sapiens
gaagttggaagaggcaaggaaggatttgagcctagagcctttggaaggagcatggccctgttggttctggcctccagaactgcaagaaaatacatttttgttgttttaaaccacccagttcatggtaatttgtaacaccagctacaagaaattaacacaaggctgatgtgactttccatcaggagagagacagccccaggtaggtgtttcagatatcacatccaatagaacaaattaaagacaaacaccctaaattctagatgttgatttgtgagcaagttatttctcctatgggcaactctagttgaaatatgcaattcattatgttgaaacatggaattgttattttcataggttaaaaaaaaatcacatagtggcaatatagtagtagtgctcgttttttgttttttgtttttttgtcaaaaatgctagacaacatggaagatcagggaaatattaacagtctgattcagtaacctttaacagcttcttttcaggttacacaggctaagctaacttttatatcaggatcaggatctgcagagttattagtatagtgctctgcagatcctggtcctagtatagcaggatctgcagaccctagttgtacctggccatgttccccaccaatgactgagaaagaaatggctcgaacagaaaacagtggtcttgaaaggcaacgcaacagtaggttacaaatagcattagctttttctttaaagaaa

SEQ ID NO: 282802 - DNA, 1091 bp, Homo sapiens
tttttctatttcagatgccttcaatgttgtgtttattgacacatccacccctttcccatttctttttcaatagggaggatactgggatgaggatgcttgtaatgtggtgcacactgattaccagagcacagctgagatactgttgggtcctgtctcctcccaaagcacacatcacatcccagggtgcacaccagtaaatgatcagattctggacatggggagccaaggacaggggaaggcagagagaggagcagaattgcaaccactgtcgtcatgaaggaagctaggtgagagagctggcacaaggtggcaacatttgcatgaagaggacaaacaactggaaataccaccagggggcgtgtgtagctgtaacacaccagtcatgctctttccctacagttaccaggcggggtttgatcactatgcataacctgagaaagatagacaaacagcagacagatagataggttgggggtgcttagatagacaaatatcaccagcctcctaagctcatcctggtgttgtgattggccacaccaaaacgtaacatctccagtctatctgatatcattgaacaggtctcctctaaggcaaggagttggattcccctagaacacctgccaaagtgcagtggaagggaaggaggtcttgcctgggggcagtggtcactgggcctgggtttctgtgctgattctgcccttagcaacctgggtgacctagggcaggtcacttaacatttctgcgctacacttttctgacttgtaaaatcacatgcttgggtggcagatgcagactgttagtaatttttaaactttagagatcacggaggagaaaactgagatccaaagaagttaaattacttgtccaaagccacttgatgtgggagtggaatgaccgagaggatgtggattctggaaccagagccagttccacatgatggttccagcacacccctcacactgccctctggtgatctactgtctcctcatctcttcctcctctgcagaatggaggaatagcagcacctacctcccaaggttttggaagaataaatgagtacctgacacaaggaaagcctccaatatatgtta

SEQ ID NO: 282803 - DNA, 1402 bp, Homo sapiens
ggcctgtctcgcttcgcggccacctcttccccaacgctacccgctccgtaccctgactcgctgctcctctgtgctggcagagagcgcgcagaacgtagctggacccaagggtttatttaccacattggctggtgtgtccatctgctgtgcaaccacatttatctccggtgagataaaccccatttatctcctagcaagtccctggcgcacagtgagctctgataaaaagcagcccatctacctcctccaaccagacccaactagcccagatgcttaattctccatgacttgtaacacctcaatacctttgtatttgctgttccatctacctggagagcctttccagggagctagaggagggagagattcctatgaactgaaaagggaggatactgggatgaggatgcttgtaatgtggtgcacactgattaccagagcacagctgagatactgttgggtcctgtctcctcccaaagcacacatcacatcccagggtgcacaccagtaaatgatcagattctggacatggggagccaaggacaggggaaggcagagagaggagcagaattgcaaccactgtcgtcatgaaggaagctaggtgagagagctggcacaaggtggcaacatttgcatgaagaggacaaacaactggaaataccaccagggggcgtgtgtagctgtaacacaccagtcatgctctttccctacagttaccaggcggggtttgatcactatgcataacctgagaaagatagacaaacagcagacagatagataggttgggggtgcttagatagacaaatatcaccagcctcctaagctcatcctggtgttgtgattggccacaccaaaacgtaacatctccagtctatctgatatcattgaacaggtctcctctaaggcaaggagttggattcccctagaacacctgccaaagtgcagtggaagggaaggaggtcttgcctgggggcagtggtcactgggcctgggtttctgtgctgattctgcccttagcaacctgggtgacctagggcaggtcacttaacatttctgcgctacacttttctgacttgtaaaatcacatgcttgggtggcagatgcagactgttagtaatttttaaactttagagatcacggaggagaaaactgagatccaaagaagttaaattacttgtccaaagccacttgatgtgggagtggaatgaccgagaggatgtggattctggaaccagagccagttccacatgatggttccagcacacccctcacactgccctctggtgatctactgtctcctcatctcttcctcctctgcagaatggaggaatagcagcacctacctcccaaggttttggaagaataaatgagtacctgacacaaggaaagcctccaatatatgtta

SEQ ID NO: 282804 - DNA, 561 bp, Homo sapiens
tttttctatttcagatgccttcaatgttgtgtttattgacacatccacccctttcccatttctttttcaatagggaggatactgggatgaggatgcttgtaatgtggtgcacactgattaccagagcacagctgagatactgttgggtcctgtctcctcccaaagcacacatcacatcccagggtgcacaccagtaaatgatcagattctggacatggggagccaaggacaggggaaggcagagagaggagcagaattgcaaccactgtcgtcatgaaggaagctagagatcacggaggagaaaactgagatccaaagaagttaaattacttgtccaaagccacttgatgtgggagtggaatgaccgagaggatgtggattctggaaccagagccagttccacatgatggttccagcacacccctcacactgccctctggtgatctactgtctcctcatctcttcctcctctgcagaatggaggaatagcagcacctacctcccaaggttttggaagaataaatgagtacctgacacaaggaaagcctccaatatatgtta

SEQ ID NO: 282805 - DNA, 642 bp, Homo sapiens
ggcctgtctcgcttcgcggccacctcttccccaacgctacccgctccgtaccctgactcgctgctcctctgtgctggcagagagcgcgcagaacgtagctggacccaagggtttatttaccacattggctggtgtgtccatctgctgtgcaaccacatttatctccggtgagataaaccccatttatctcctagcaagtccctggcgcacagtgagctctgataaaagtacgttgaattggaacctggaactggactaacagctcccaagttcgtatctccgcctcagatctccttttaaactctagacgtgtgcatccatctgcctccatgcatccgcctccatgcatccgcctccgcatccgcctccatgcatccgcctccgcagcacctcccttgggatgcctaatagactctcaaatgttacatgccttctgtattgctccttcccccatcatttcatgcgtaggcagctagcagtctctgccacttttccttgctgtggtcttctgctcaaatatcagcttttcaaagaggtcttgaacaccctaagacagctctgtcatcctctctgctccctggcctttcccagcactctcttgttttgctttattttttctttatgatacttatacctacctga

SEQ ID NO: 282806 - DNA, 758 bp, Homo sapiens
taaataaccacaagcacattagggggggcatcctgtgttgttcaggttccttctgggtggcaaactagctctgggccctgtccagacagggacatggacagatggagtgagtccagagaaaggcacccaaatggcaggagaccagatatcagtgctttaagggagcctgtgcaccctggccaaccccacacagcagagctgggagcacaagcagaagcctcagcaggcagtgctggtccacagtggagccagctgccccaggagggaagtgggctccctgaggctggagatatttaagcaggggcattttggaagggattcttagggtatcctgagggttggatgtgacacacacaggacccttcaactctgaggtcacgaggaaggaggcgctgtgagaaacatgtttgtgaaaggaaagaccttgggccactggggaaggcctagctgcctccagcttggtggtggacagagccccagccgggaggccggggacctaagttctggttccactctaccctgtctctgtgtctggcctggagtaggaacctgccctctctgtgccgcctgctgcccagaacacctggtagatgaggctgaggctcagtgaggttgtggagccctcctgcctctatgggagtcccactgccctgaggctctgcttctgctctaggtcctacccctgccctgcccccactcctcctgggctcctggaccttcaggagcccatgtccctccccagggctgaacgagtgtct

SEQ ID NO: 282807 - DNA, 500 bp, Homo sapiens
ctttgtgaggttgaccaagtgattgaggagtgactttgaatgtgtggctatgcgtatttgagtgtgaatgtctatcattagatgctgctgtggatgcttgactgcccttactcactgttccatcagtccctacatcacacactaatccttcccccagcttcactgcccagagcttaggagcacatgggaaatggctatcctagatgaggaaggagtctgtggcaacaggccgagaattagggcccaggagtgtcacaggttacacagtacatctccaactgcctctgactcacctagtgccccaggtaaaaggcacccagataaaaggtaggggaggaggagagagagagaaggaagagtctaggctgagcaacatgaaggggcccccaaccttctgcagcctcctgctgctgtcattgctcctgagcccagaccctacagcaggtgagtacttgggggtatagaaagctgggggtctgggtgaatgggatgaagttgaa

SEQ ID NO: 282808 - DNA, 492 bp, Homo sapiens
gcctgctgtactcagctctaccgaaagccactctcagacaagctactgaggaaggtcatccaggtggaactgcaggaggctgacggggactgtcacctccaggctttcgtgtgagctcccacccctgatacccctgactctgacctcagtcccaacccctaatgctgatcccaaccccagccctaactgctaattctgttgccaactcaggttttcatctggtccttgctcctaacccctaattagggtcattggggatgaccctaatctcatccccaagctatggtcatagctttggacctttctctacccaggcttcacctggctcaacgcagcatctgcatccacccccagaaccccagcctgtcacagtggtttgagcaccaagagagaaagctccatgggactctgcccaagctgaattttgggatgctaaggaaaatgggctgaagcccccaatagccaaataataaagcagcattggataataat

SEQ ID NO: 282809 - DNA, 439 bp, Homo sapiens
cccagataaaaggtaggggaggaggagagagagagaaggaagagtctaggctgagcaacatgaaggggcccccaaccttctgcagcctcctgctgctgtcattgctcctgagcccagaccctacagcagcattcctactgccacccagcactgcctgctgtactcagctctaccgaaagccactctcagacaagctactgaggaaggtcatccaggtggaactgcaggaggctgacggggactgtcacctccaggctttcgtgcttcacctggctcaacgcagcatctgcatccacccccagaaccccagcctgtcacagtggtttgagcaccaagagagaaagctccatgggactctgcccaagctgaattttgggatgctaaggaaaatgggctgaagcccccaatagccaaataataaagcagcattggataataa

SEQ ID NO: 282810 - DNA, 1259 bp, Homo sapiens
gctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtc

SEQ ID NO: 282811 - DNA, 2533 bp, Homo sapiens
gctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggacaaaaaaaaaaaaataaaacaacaaccaacaacggggcgcgcccgccaaatagctccccccacgagggggacccactactagaccgctgccccgattgtctggtgccaccgcggcgccccaagggagcaccacatcaaacggacagccagtggccacctcaccgacccgggcacggagaaaccacccagcccgtcgactctgaagcgaaccaaccacggcgcggcacacagcgagacccccaaacggatgagcctagggcatcacactacggcacggtcacacacatgcgcggcatgcccgtcac

SEQ ID NO: 282812 - DNA, 470 bp, Homo sapiens
ttagggacatatctcagaaaacttccagcctgaaacgcgtacatccaggttcaccacagcacgattcacagagccaggagtggggggcagctagagcatccataggaggacaagtgggtcagcccagcctccatcagattcacagagacagaaagtaggatgggggtgggtgccaggggctggggacaggatgagcaggaaatgtttcaccgggacagagtttgaagatgtaaagtggccgggcgtggtggctcgcgcctgtaatcccggcactttgggaggccgaggtgggcggatcacctgaggccaggagtttgagaccagcctgagcaacacggtgaaaccccgtctctactaaaaatacaaaaattagtcaggtgtgggggcgggcaccttgaggatgtcacgctcagtgggagacgccaggcataaaatgacaaatcctgtgtgattccactcctaggatgtcc

SEQ ID NO: 282813 - DNA, 2279 bp, Homo sapiens
gctgcgtcgtcgacgctgggctttcgggtcccgcgcccaggtgggaagaggccggcgactggggtgaccgcggggaaactgaggcagagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggaca

SEQ ID NO: 282814 - DNA, 2535 bp, Homo sapiens
gctgcgtcgtcgacgctgggctttcgggtcccgcgcccaggtgggaagaggccggcgactggggtgaccgcggggaaactgaggcagagagatgggctccaaggcaaagaagcgcgtgctgctgcccacccgcccagcgccccccacggtggagcagatcctggaggatgtgcggggtgcgccggcagaggatccagtgttcaccatcctggccccggaagggatgggggtgtcactatgttgtccaggctggtctctaactcttgggctcaagtgttcctcccgcctcggcctcccaaagtgctggattacaggcgtgagccaccacacctggctgcatccgtcatgttaagaagaccccggctggcaagctcactcggggactgcagggaaccctgccctttgggggcagtagtgaggggtgcccaggaggatggggtggtcagcaggcagtgatgctgctgtgtcctgtctcagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggaca

SEQ ID NO: 282815 - DNA, 563 bp, Homo sapiens
gctgcgtcgtcgacgctgggctttcgggtcccgcgcccaggtgggaagaggccggcgactggggtgaccgcggggaaactgaggcagagagatgggctccaaggcaaagaagcgcgtgctgctgcccacccgcccagcgccccccacggtggagcagatcctggaggatgtgcggggtgcgccggcagaggatccagtgttcaccatcctggccccggaagaaggtagggggagcccggtcccggggaaaagcggacctgagaccccggcagcaaggggacgggagagaagcacacccctaactcctgaccccacgccctgggaacccccgcaacatgggcacggtccgtatcctctccgagtctccctctactcctccgtagagtgggaccgattttcagagggttcttctgacaggggtggaggccgggcgctgtggttcaggcctgtaagcccagcactttcggaggatgaggcgggaggatcgcttgagcccaggagttcgagaccagcctggccaacatggtgaaaccccgtctctgctaaaaatgaaaaaacaaaac

SEQ ID NO: 282816 - DNA, 1087 bp, Homo sapiens
aggagagcccatggtgtagttccagtccaagcccaaaggcatgagaactaggagagctgatggagtaaatttccagctgagtccaggtccgagtctgaaagcaggagaccagtgtcccagctggacacagagcaaattcccccttactcagccaatttgttttattcaatggattggatgaggtccacccacattggagagagcaatctgcttgactcagtctaccgattcacatgttaatctcatccagaaacgacccacagacacaatagaataatgtttaaccaaatgtctcagcaccctgtggcccagtcatgttgacacataaaattatcacaagtactctgctcctgattattttatgtgataaggttattactattttagagttaggagtaccttagggactattggcttagtaactgtcattttgcaaatgaggaaatcaagacccagaaagccttgttagtgaagactggagtccagattcttctttttttttactgcactccagcatgggcaacagagcaagaccctgtctgtctcaaaaggaatgaggctctgaaacaaacagactatggcgtaggtgcaccttgaggatgtcacgctcagtgggagacgccaggcataaaatgacaaatcctgtgtgattccactcctaggatgtccctagctccatcagattcacagagacagaaagtaggatgggggtgggtgccaggggctggggacaggatgagcaggaaatgtttcaccgggacagagtttgaagatgtaaagtggccgggcgtggtggctcgcgcctgtaatcccggcactttgggaggccgaggtgggcggatcacctgaggccaggagtttgagaccagcctgagcaacacggtgaaaccccgtctctactaaaaatacaaaaattagtcaggtgtgggggcgggcacctgtaatcccagctactcggaggtggagtttgcagtgagctgagattgtaccactgcactccagcctgggcaacagagtgagactctgtctcaaaaaaaagttacagcaagacttttctttttgagacagggtctggctctgttgccca

SEQ ID NO: 282817 - DNA, 2230 bp, Homo sapiens
gctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggaca

SEQ ID NO: 282818 - DNA, 757 bp, Homo sapiens
gctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagactgcactccagcatgggcaacagagcaagaccctgtctgtctcaaaaggaatgaggctctgaaacaaacagactatggcgtaggtgcaccttgaggatgtcacgctcagtgggagacgccaggcataaaatgacaaatcctgtgtgattccactcctaggatgtccctagctccatcagattcacagagacagaaagtaggatgggggtgggtgccaggggctggggacaggatgagcaggaaatgtttcaccgggacagagtttgaagatgtaaagtggccgggcgtggtggctcgcgcctgtaatcccggcactttgggaggccgaggtgggcggatcacctgaggccaggagtttgagaccagcctgagcaacacggtgaaaccccgtctctactaaaaatacaaaaattagtcaggtgtgggggcgggcacctgtaatcccagctactcggaggtggagtttgcagtgagctgagattgtaccactgcactccagcctgggcaacagagtgagactctgtctcaaaaaaaagttacagcaagacttttctttttgagacagggtctggctctgttgccca

SEQ ID NO: 282819 - DNA, 2300 bp, Homo sapiens
ccgggagcgggaccgcgacgggtgcgtacgagttcgctgggcgggaggagcagcccgggcaagggcggagaggtggacgccccggtcagcgcccccttccccgccttcagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggaca

SEQ ID NO: 282820 - DNA, 527 bp, Homo sapiens
agcaatcttcccatctgacagagaatcaacaagatcctgaaattctgcaggaacatctgcttgcttccagcgctcattgtctaagaggaggctagtccacagtaaggagaaaagaagtcatgggcaaccacaactgcagacctcaatctactatacacatcaaggaattaaactttttactgtaaatgtcatgacttctctctgcttcttgggagtacttccagcatcaccagtgaacttagtatgggtcccatggtgttatttaaggtgtatagtatgtattaaagacaataaaaaccatgcaaaaactataagagatcaccttttactgtgatactcaatttactggagagaggaactgctcaaacatagatgactagcatcacttcagctcaccacagtagcaacaggaggtggttatgaaattattacagtggtacaatatgtaccacagttagttttctgcagttatgatttaatactgcatgagtggggccatatacagtctgtgtgcaagtttggataaa

SEQ ID NO: 282821 - DNA, 356 bp, Homo sapiens
agcaatcttcccatctgacagagaatcaacaagatcctgaaattctgcaggaacatctgcttgcttccagcgctcattgtctaagaggaggctagtccacagtaaggagaaaagaagtcatgggcaaccacaactgcagacctcaatctactatacacatcaaggaattaaactttttactgtaaatgtcatgacttctctctgcttcttgggagtacttccagcatcaccagtgaacttagtatgggtcccatggtgttatttaaggtgtatagtatgtattaaagacaataaatagccgcaactggccgcgccctttcctgttcacttcaaccaccagtcgctcgccgcgttac

SEQ ID NO: 282822 - DNA, 655 bp, Homo sapiens
  misc_feature (33)..(33): n is a, c, g, or t
  misc_feature (35)..(35): n is a, c, g, or t
agcagccaatcacaagactcttgcgtagcaccngnaaagaggactagctgcaaagactctcttattattccccgctacaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatatgagaacgcatatgggcttccagatgacgctcataagcagatgcaaatggacaaagatgacatcgatgaggtttttcacctgtttcaaaagaaaaatgatggagaaactacaagagtagttcatttatggaaagttttgcttgtccattcattggacaactggaaattgatcaaaaagaaaatgctttcagaaagtcatatttgcatagcatatgagattgttaaaatttgtaaataaacccacaaattgaaataaagctta

SEQ ID NO: 282823 - DNA, 754 bp, Homo sapiens
ggagactatgcgcaggcgcggtgcactgcgcgccggcacgagggtgttttcgacgttggctgtggggaaacagcaagcggcgtggacgaccgttgctgagctggtgtggaacgtctgtgatcagattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccaggtattccactcaatcatccctccctggatgctcccctgtgccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 282824 - DNA, 463 bp, Homo sapiens
aagtccctttcaggttagtcttttctgctcacacgtttcctaacaagttatttaaattctttgacgtgtttcagatgatttttgagtatcacattgagaccttttttctatatattacactaactcaattgtgattgtttatagaatctaactggtttgtttaatcaaattaatttcctaatgtcattagacaccccggattactttaatttacaccagtaatttgagaatatctttttattttagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 282825 - DNA, 391 bp, Homo sapiens
  misc_feature (33)..(33): n is a, c, g, or t
  misc_feature (35)..(35): n is a, c, g, or t
agcagccaatcacaagactcttgcgtagcaccngnaaagaggactagctgcaaagactctcttattattccccgctacaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 282826 - DNA, 727 bp, Homo sapiens
aagtccctttcaggttagtcttttctgctcacacgtttcctaacaagttatttaaattctttgacgtgtttcagatgatttttgagtatcacattgagaccttttttctatatattacactaactcaattgtgattgtttatagaatctaactggtttgtttaatcaaattaatttcctaatgtcattagacaccccggattactttaatttacaccagtaatttgagaatatctttttattttagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatatgagaacgcatatgggcttccagatgacgctcataagcagatgcaaatggacaaagatgacatcgatgaggtttttcacctgtttcaaaagaaaaatgatggagaaactacaagagtagttcatttatggaaagttttgcttgtccattcattggacaactggaaattgatcaaaaagaaaatgctttcagaaagtcatatttgcatagcatatgagattgttaaaatttgtaaataaacccacaaattgaaataaagctta

SEQ ID NO: 282827 - DNA, 503 bp, Homo sapiens
ggagactatgcgcaggcgcggtgcactgcgcgccggcacgagggtgttttcgacgttggctgtggggaaacagcaagcggcgtggacgaccgttgctgagctggggtggaagggattccccagcatagcacagctgctctacaaaaacatggccagactttttgcaaagatctgtgagagaagtgtgggtttccaatcctgtttctcctttctgggtgggacctcccagctggggtctccagccacccctgccagtcagagttttgaaacctccctgggactaagcttccagaaggaagggcaagctgccatctttgctgtttaggtgacttagccattccagccttcatgccaaccacagggtagaagcggtacccaacaggcccaggtgtggctcatgataccattctggaggttacaaactgtaaactttggtggcatctacatggtactaattctgcaggtacacagaatgtaagaactgtggagacatgtcttccttc

SEQ ID NO: 282828 - DNA, 1590 bp, Homo sapiens
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaaaaaacaagatgcggccgaacctctcccgaatccttccgacgcgcgttaacccacaa

SEQ ID NO: 282829 - DNA, 1941 bp, Homo sapiens
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaaaaagaaactgaagagacctgatgctcataatcaggaaaatcggcaaatggctgggactacaaccctggtctcttgaatcctgtttggaaatctgtgcgttaggagggaaatttccattcctacagcttcatgggaaaaggtctactccatttcaggaggtaacagtcctggcatgcacaattcaagccccctgcttcaccggttcctcactcctcactaggagaagtgattctgctggttgagacaagaccaatatccaagagggctacactgcattcgagggacaaggctcagtgtcttcctctctcccactgctttcccaagccagtcactatcacattttaatgtgtatgtgaattacttgggggatcttattaaaacacagattataattcagtagatctggg

SEQ ID NO: 282830 - DNA, 1798 bp, Homo sapiens
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatatgagaacgcatatgggcttccagatgacgctcataagcagatgcaaatggacaaagatgacatcgatgaggtttttcacctgtttcaaaagaaaaatgatggagaaactacaagagtagttcatttatggaaagttttgcttgtccattcattggacaactggaaattgatcaaaaagaaaatgctttcagaaagtcatatttgcatagcatatgagattgttaaaatttgtaaataaacccacaaattgaaataaagctta

SEQ ID NO: 282831 - DNA, 1534 bp, Homo sapiens
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 282832 - DNA, 1705 bp, Homo sapiens
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaaggtaatcaggaagccttctcagagatgacatttaagcaaagatgggtaagagcgaaccatgcagctatctggaggatcattctaggcaatgaacacatcaagtgcagaagcgcaaaggttggctggttgcagtgttgcagaatcgagaagaggccattgagcacggggtgagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 282833 - DNA, 894 bp, Homo sapiens
aacctctctttccagccctgaccagagctccagacctctgggtccaactgccttatggatccctctccctgaatgtcacataggagaggggacaggggttggccacacacctggaaatggagttctctgatgcaatgtcctttggggtccggactgtggtgaaggttcgtccagctccacgcccacccactggccgctggcaaactccgtggtcccacagaaccgcagtgtgcccgtctggggagagaagggaggcgatggctaaggaaggaatgctgggaggccaacgtggagtgcccacacacgggcagcaagaaaagaagagagggcaatgcaaccatggaggcagagactggagagatgtggccacaagccaagcactgcctgcagccaccaggaaccggaacaggcaaagaagagattctcccccagaacctccagaggagtacagccctgccgacaccttggttttggcccaggaaagccgatttggactcctggcctctagaactgttagaaaataatttgtcttgttttaagccaccaagtttgttagagcagcatgggaaactaatagtgtaataaagggagaaataagaatgtctttcacatttgctggtatttatataaagaaactatggtaatgtggtttggctctgtgtccccacccaaatctcatcttgaactgtaatccccatgtgtcaagggagggacatgatgggaggtgactggatcatgggggatgtttcccccatgctgttcccatgatagtgagtgagttctcatgagatctgatggtttaaaagtggcagttcccctcttgctctctctctctcctgcccccatgtaagatgtttgcttttcctttgccttgcaccatgattgtaagtttcc

SEQ ID NO: 282834 - DNA, 768 bp, Homo sapiens
cggcctcccaatgtgctgaaattacaggcgtgaaccactgtgccaggcctgaatattaccttatatgacaaaagatgtgattaagttaaggatcttgagatggggagattatcctgggtcatccgggttggccctaaatgccactacaagtatccttttaataagagggaggagaatatattaccacagaaaagaagagagggcaatgcaaccatggaggcagagactggagagatgtggccacaagccaagcactgcctgcagccaccaggaaccggaacaggcaaagaagagattctcccccagaacctccagaggagtacagccctgccgacaccttggttttggcccaggaaagccgatttggactcctggcctctagaactgttagaaaataatttgtcttgttttaagccaccaagtttgttagagcagcatgggaaactaatagtgtaataaagggagaaataagaatgtctttcacatttgctggtatttatataaagaaactatggtaatgtggtttggctctgtgtccccacccaaatctcatcttgaactgtaatccccatgtgtcaagggagggacatgatgggaggtgactggatcatgggggatgtttcccccatgctgttcccatgatagtgagtgagttctcatgagatctgatggtttaaaagtggcagttcccctcttgctctctctctctcctgcccccatgtaagatgtttgcttttcctttgccttgcaccatgattgtaagtttcc

SEQ ID NO: 282835 - DNA, 375 bp, Homo sapiens
tggccctgggaggctacagggactcaaggacttcatcatcaaagtcctgtgccggctagcttccagttgtattgagtcaatggagaatctggcagattggaggaaggagaaggtcatgatcatctggcaattaaagaaatggccagactgcctcccactctgaggacccttggctacctgacacgtaattccagagaccacagtagtcagtgctggcaagattccagagcccagaagaaggagcaatcttttgaaaatctccttggaaggcacactcaattcaaagatgaccatgggaatgattgacctagcttccaagagattcatttgatgtttagttacaggatatccatcgatgacaacactaacaaggaa

SEQ ID NO: 282836 - DNA, 5787 bp, Homo sapiens
  misc_feature (591)..(591): n is a, c, g, or t
  misc_feature (824)..(824): n is a, c, g, or t
ttcctccgcgaaggctcctttgatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatatggtccggaaaaagaacccccctctgagaaacgttgcaagtgaaggcgagggccagatcctggagcctataggtacagaaagcaaggtatctggaaagaacaaagaattntctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatntccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaac

SEQ ID NO: 282837 - DNA, 3384 bp, Homo sapiens
tagaggatcccctgtcctactagtccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttca

SEQ ID NO: 282838 - DNA, 3384 bp, Homo sapiens
atcctcctgtaatccaagcagtcgccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttca

SEQ ID NO: 282839 - DNA, 8325 bp, Homo sapiens
aatgaagaacagctggaagatatgagacaggaacttgtacgacaataccaagaacatcaacaggcaacggaattgttaaggcaagcacatatgcggcagcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttca

SEQ ID NO: 282840 - DNA, 8292 bp, Homo sapiens
tgctatgcggtcgatctggcaaacggcggttcgactctgactacgcggctcgatctgactacgcggcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttca

SEQ ID NO: 282841 - DNA, 7067 bp, Homo sapiens
caagagcactgtcacccctctgattctgcctaagaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttca

SEQ ID NO: 282842 - DNA, 2593 bp, Homo sapiens
aatgaagaacagctggaagatatgagacaggaacttgtacgacaataccaagaacatcaacaggcaacggaattgttaaggcaagcacatatgcggcagcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatcca

SEQ ID NO: 282843 - DNA, 10332 bp, Homo sapiens
  misc_feature (749)..(749): n is a, c, g, or t
  misc_feature (982)..(982): n is a, c, g, or t
ttcctccgcgaaggctcctttgatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattntctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatntccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttca

SEQ ID NO: 282844 - DNA, 2754 bp, Homo sapiens
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacatt

SEQ ID NO: 282845 - DNA, 1192 bp, Homo sapiens
  misc_feature (1028)..(1028): n is a, c, g, or t
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatggggcaaangagtggtagtgggtgcccccaaacaccagaacaggaagactcaaagaggctttgtaaggggcagattgagccaatttatagggcactatacttaggggcaatagctttataatttttatgcagaaccgggtcattggtaacagcttattgaagaactggtacag

SEQ ID NO: 282846 - DNA, 3929 bp, Homo sapiens
  misc_feature (2842)..(2842): n is a, c, g, or t
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggngaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgcatacacgc

SEQ ID NO: 282847 - DNA, 3785 bp, Homo sapiens
  misc_feature (2698)..(2698): n is a, c, g, or t
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggngaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgcatacacgc

SEQ ID NO: 282848 - DNA, 3315 bp, Homo sapiens
  misc_feature (2228)..(2228): n is a, c, g, or t
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaataagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggngaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgcatacacgc

SEQ ID NO: 282849 - DNA, 193 bp, Homo sapiens
tttactaatttaatttctaactactcaggaatttgttttgatagcaattattttaatatttttcttctatttttcctacaaagaataaaatacagtgttggatccctttctcctgtttctgcaagtgtcctgaaaaagactgaacaaaaggaaaaagtggaattgcaacatatttctcagaaagattgccagg

SEQ ID NO: 282850 - DNA, 2693 bp, Homo sapiens
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacatt

SEQ ID NO: 282851 - DNA, 2694 bp, Homo sapiens
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacaga

SEQ ID NO: 282852 - DNA, 3837 bp, Homo sapiens
  misc_feature (2750)..(2750): n is a, c, g, or t
aattcggcacgagctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggngaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgcatacacgc

SEQ ID NO: 282853 - DNA, 118 bp, Homo sapiens
tgttaaggtagtgattctttttatgcttccaagtatctttcatgggtacagtcaatgacattttcctttgtttttctatctttagtggagatagtggacccagtggatatctatctta

SEQ ID NO: 282854 - DNA, 478 bp, Homo sapiens
attggatgactgattattggacagaatggcatcttgtcaacacctgcggtctcctgcattatcaggaagatcaaggcagctggtggaatcattctaacagccagccactgccctggaggaccagggggagagtttggagtgaagtttaatgttgccaatggaggtatgtggttcagtatatgccttaataatcacgatttccttcctcttatattattatagtctcacagtgaccctttgatgatagacaagcaaggtgcagaggacctagctcagaaaaatttagtgaggtgcccaaagtgatccaacaaagaagtggcatgatgggctcatgaacccatttgggtggtctcttggtcccctgtactcttcagcataaactattgaatagttgatgcttatctgatatggaaggactctgaattttaacattaaaacataccctgaaggtcgttgtctaaatgacaatgaccctcat

SEQ ID NO: 282855 - DNA, 1970 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
  misc_feature (1338)..(1338): n is a, c, g, or t
  misc_feature (1866)..(1866): n is a, c, g, or t
gnangngngggcggtccccaggcgggcgggcgcagggcgcagggcgccgacctgctggagagggggccccgggcgcgaggcggagtcccggcgcgcagccaggctggtgggggcccccggcaggctgcagattccctccggctccgggagccgcagcaggaccggccaggaggcgccatagaggggagccccatcccggtgctgacagtgcccaccgcgccctacgaggaccagcggccgtccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggatgactgattattggacagaatggcatcttgtcaacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccaaatcgacctatctcgactaggaagacaagaatttgacctagagaacaaattcaaaccattcagagtggagatagtggacccagtggatatctatcttaacctccttcagaccatctttgactttcatgccatcaagagtttgctgactgggcccagccaactgaagattcgcgttgatgcaatgcatggagttatggaaccttatgtgagaaaagttctgtgtgatgagctgggggccccagccaattctgcaataaactgtgttcccctggaagactttggagggcagcaccctgacccaaacctgacatatgcaatgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccatcagatgggggtccgcgggtttgggaggagtatgccaaccagcatggccctggacagagagacatctggtgatactatctgttgattgcaaagaaaaatatacccgactaataagaagaaaatgaatggtgcataatgacccaatctcctttggatataataaaactatgcctgntttgtggtcttcatttacatttagaatacctgaaacttggtaatttatgaagaaaaggaattcatttcttacagttatggaggctgagaagtccaaggtccaggggcataacagctcagagtaatttgatcgtctgaagccttctctcagctcttcaaagtcattctccgtccagctttgttccgttgctggtgagcagctgcgttcctctggaggaggagaggcgctctgatttttagagtttccagtttttctgttctgttttttccccatctttgtggttttatctacttttggtctttgatgatggtgatgatgtacagatgggtttttggtgtgtggatgtcctttctgtttgttagttttccttctaacagacaggaccctcagctgtaggtctgttggagtaccctgcagtgtgaggtgtcagtgtgcacctgctggagggtgcctcccagttagaataactaatatagagaagtgcttaaaggagctgatggagctgaaaaccaaggctcgagaactacnggaagaatgcagaagcctcaggagccgatgcgatcaactggaagaaagggtatcagcaatggcagatgaaatgaatgaaatgaagcgagaaggaaagtttagag

SEQ ID NO: 282856 - DNA, 984 bp, Homo sapiens
  misc_feature (19)..(19): n is a, c, g, or t
tccgtacggcagtaccctnggggtaatggtagcgaggctgggtggcgccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282857 - DNA, 1043 bp, Homo sapiens
  misc_feature (65)..(65): n is a, c, g, or t
gagagaattgaaaatattgttcccagtccgatgggcccccgtgtaactgggaggtgcaccttttncgcagccttccccagcaatatcaccgggccatgctgccccacctttcccgtttacacgggcccgtggctagtcgtgtccctgggcggcttgacggagtcgacggtgaggaggcgtcgggctggctggggcaggaggtggctccaggagtgcctggtgcttccctgtctcttgggagcgtgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcctgcggccgcagccttggagctcccagcgtcccctcggggttcaatcctccaggacctgtgtctgatgcctgcatgtgggtacctgggctccatcaggttctagatcggcctccgccctccactttcagggctccaggcccagcttctcatgtctgtggggagggtctccagagccttggtctgtggctgagctgtggaacttgaaggcctctctgcatcttgtcactcgtggcccctgcaccttgggtcatgacctgctttatgtggcaaccctgtgacagctgctaagtcctagaaaacacgtaacaggacgtgaggtgccctctgcgccgtgtgggcgcgtgcggggagacccgggccccaggacgtgaggtgccctctgcgccgtgcgggcgcgtgcggggagacccgggccacatgcgagcggggccccgagacattctgcactcgggaattgcggggattatcaaatcccgcttcagtgggaaacgtgagcgaaacccaaggtgagtggccgcagcctttcgtcacgtgctctcccgcatgtcctaagtgagggctcaggctgagctgccgttgccgagagccttgtgtctgcttcgggtgtctgcactgtgagtggctccgtgctggcgtcc

SEQ ID NO: 282858 - DNA, 979 bp, Homo sapiens
  misc_feature (25)..(25): n is a, c, g, or t
  misc_feature (33)..(33): n is a, c, g, or t
  misc_feature (728)..(728): n is a, c, g, or t
  misc_feature (745)..(745): n is a, c, g, or t
  misc_feature (864)..(864): n is a, c, g, or t
  misc_feature (904)..(904): n is a, c, g, or t
ttaggctagtacgagctgggtgttnaatctggncgaggctgggctctggtccaggctttgtagaccgtgcaggcggctgcatccccgacctgacccaggcctgctcgctctggtgtgcaccgacctgccagctttgtggcactttgtggcatggggctcaggccgatggagggcactttccctcatggtattgatattttgaccacagctgactattttgccgtcggtaacagatccaactgtttcctggttataagggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaagatgcagcagtctcgaccctgtgnagctacagaaatgcatnaagccacgtgagtgggcctgttctttctgtcaatcatctggcatagagtatccattttgtgtccatcataggcaagtgcaagccttatataatgttaccaacatagatcacacctcagnatcttgcttgatgtgagtgctcatttttccatcaaacctntccacctacttcctccctccctccctttttgctgtgattcagtccatatattgggcatctagcatattccaggtc

SEQ ID NO: 282859 - DNA, 901 bp, Homo sapiens
cacaggcccctgggttgagaatcggacgaggtggtcataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcagtctcccggttagagcgttcccacattcccgggacgtagtcgtgagtcggagagcggtgagctgcgggtgcggcgtggtgagcggccgaatgggggggcatgtcttgggccgggtgtgtaccggggggcgc

SEQ ID NO: 282860 - DNA, 877 bp, Homo sapiens
ccacactgggctgccagagcacagtgaagggagcccccagggctgtggtgtcccggggctgtctcagcagcctcagaagttaggactttttttttgttaattgaatagccttcacatttgttgcttgtgcaggatctaattgagttaaagatttgggtttatattggtgggagccgggggagaccgtttgaaggaaaagatttaggggtaacaaaagaataaaagtttcccaaaatgtgatgtataaaaatttacagaatgctggtatttccctcaataagagcttacacaatttaacagccatgagaggaaggggccttagacttaacacaacgtggagaatgttcactttggcttttccacagattcctctcaaaggttaccatcgactttaagattagtattaatagaagctgtttttgctgttgtttttgatttcatggtgtttttgattgcctgggtacgctaacttgattttttgacagatggttggcaatggctgataaatgacactttgagacatctccatctcatctcaagtcactcccgccagcagatgaagaggtacagtgagcatgggcgttcccggccggcgctgtggcggtgttagtgtgttagtcacggatggtgtttgtgttggcgactgtgcatcatgaggctgtccctgcagtagcctgataactgacaaatgggggcataattctatttggaatcccggatggtagcgtctacacggtttataaccagaaaatccaatacagccattggaatccgaatgtttaattttttattgcttctggctgttttaattatagttacctttgaaatactttttctgcatcaatagtaactgtgctctgttgagttccgtgtcctg

SEQ ID NO: 282861 - DNA, 4444 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataaaaaaaaaa

SEQ ID NO: 282862 - DNA, 3951 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282863 - DNA, 4153 bp, Homo sapiens
  misc_feature (745)..(745): n is a, c, g, or t
cggccagggtgcggctggttcttgggtgtgcctcacagacacaggacactttttagggttgcttttgaatgtgcctgagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagntctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282864 - DNA, 3767 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacatcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282865 - DNA, 3984 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaaaaaaaaacaaaaaaaacagacaaaaaacaaacc

SEQ ID NO: 282866 - DNA, 2733 bp, Homo sapiens
ggccccgtcaccgtcgaggctgcctggcttggtctcagggtggctgggcccatcctcagaaccttctgtcccagtcttctgtggaacagcagcagcaggttctgcagctcgtggtcgaccggggaaggcaggcctcggagcctgggtgttacaggggtccttcaccgagagattgagtggaaggtcctgcagctctgagaagctggcggtttccgcctgggggctgccttgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282867 - DNA, 2488 bp, Homo sapiens
gaagtcctgtccctccttggggctggacacggtcccttgcccctgaactctagacgccctgcattgccctggtgctcccatgtcaagactggccgcggtcgtccatcccatggtttgtgaccctcccagcaacgctgtgaggaaggtgctgcagctggttctcagcattggcaggagcatggcgactcaggcagtcagtgtgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282868 - DNA, 2170 bp, Homo sapiens
aaggctaggtagaggcgggggtaatcggccgagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282869 - DNA, 2347 bp, Homo sapiens
  misc_feature (25)..(25): n is a, c, g, or t
  misc_feature (33)..(33): n is a, c, g, or t
ttaggctagtacgagctgggtgttnaatctggncgaggctgggctctggtccaggctttgtagaccgtgcaggcggctgcatccccgacctgacccaggcctgctcgctctggtgtgcaccgacctgccagctttgtggcactttgtggcatggggctcaggccgatggagggcactttccctcatggtattgatattttgaccacagctgactattttgccgtcggtaacagatccaactgtttcctggttataagggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282870 - DNA, 3997 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcgtgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcctgcggccgcagccttggagctcccagcgtcccctcggggttcaatcctccaggacctgtgtctgatgcctgcatgtgggtacctgggctccatcaggttctagatcggcctccgccctccactttcagggctccaggcccagcttctcatgtctgtggggagggtctccagagccttggtctgtggctgagctgtggaacttgaaggcctctctgcatcttgtcactcgtggcccctgcaccttgggtcatgacctgctttatgtggcaaccctgtgacagctgctaagtcctagaaaacacgtaacaggacgtgaggtgccctctgcgccgtgtgggcgcgtgcggggagacccgggccccaggacgtgaggtgccctctgcgccgtgcgggcgcgtgcggggagacccgggccacatgcgagcggggccccgagacattctgcactcgggaattgcggggattatcaaatcccgcttcagtgggaaacgtgagcgaaacccaaggtgagtggccgcagcctttcgtcacgtgctctcccgcatgtcctaagtgagggctcaggctgagctgccgttgccgagagccttgtgtctgcttcgggtgtctgcactgtgagtggctccgtgctggcgtcc

SEQ ID NO: 282871 - DNA, 3362 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcgtgtatggagctgggccttttcttccattgctttctatctctctcgggcatatttggttagggggtcaggggcccagtgtcttcctcatgacccaggagctctaggccccatgccatgcatcaggagatccagatggccgccgatccagaagcccaagctgtgcgg

SEQ ID NO: 282872 - DNA, 1820 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggagtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggacctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282873 - DNA, 3121 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagacttggtcattgtccctcagatgcctccagagcacacggtgcaggggtgtcacctttccgacgtacccatgggtgcccggagttgcctccttagtgggatcaagaccatcccccacatgtcatggacagctggtgacctggtcgctcttggtgtttgagcagtaagtctgcacaggagccactgcccaccatgaaaggggggagttaaaggcgttccgaatccctttggccaacgacggagttgaaggtgttccgagtccccgtggccggcggcgacagagttgaaggcgtttggagtccccgtggctggcggtgatggagttgaaggcgttccgaatccccgtggccggtggtgacggagttgaaggcgttccgagtccctgtagctggcggcgatggagttgaatgcgttccgagtccccaggacgccattttggctgaatttcctttaccctcctgctccgtgaagcggggcccattggggaggtgctgctctgtaatctgctcttcttcttgaatgtgtggttagggcagccacattgatgtcccccaggctccagagtgaccgccccttaggggtcctgctgggcgttggccgctgttggccgcagggcaccgttggcctgtgcattgctgccacctacccatgatgggcagaattgtcacgagctcaggaggaaaccatggaaaaaccgcaggtcctggagcctccgtgtggttgtcgtgggcagctttccacgcgacgtgccctccctgggcgtgaggctgcatttgcacttagcggggagagggggaatgttgtgggttctagttgggctttttgatgatgatatttggaaagacttgagacaaagtagccaccctgtcctgtcccttcctcacccaccacacccactgctccccgctggcaggcactgcaggctgcacaagtaaccgtggaacctaaacactg

SEQ ID NO: 282874 - DNA, 898 bp, Homo sapiens
ttctctttggagaagtgtcttcatttttttctgttctccttccctgactgttgtggtctgatcctcccttgtcacacatgtgacttgagggtgttttctccctgcctgtcctttcacgcaccgagcgggggcctcacactttcctcacgtcccagcatctccccttgttctctgaggcacagatttttctgggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282875 - DNA, 2416 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaagcgaccagcagcttcacaaatgtctgctgcaaggggaatcgtcagagtccaatgtgtgcctctacagtaatgtcggaaataaataccattcttgaaataaaaaaaaaa

SEQ ID NO: 282876 - DNA, 1013 bp, Homo sapiens
gccaagcctgaggggtggcaggctcgggggtcccactgccttctgaggtgtctccgtgttgcagatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggagtgaggctctgcttttcatgacttcctttccgattaagcctaagtagctcatgtattaaagaaaaagtcatcagacacagagatcagaattccaggaaatgatcttccagtgcgttctggccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282877 - DNA, 576 bp, Homo sapiens
gtggggctcacctggagccatgtgctgctcccggcaggttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282878 - DNA, 1684 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctcttgggatcctctagaacagcc

SEQ ID NO: 282879 - DNA, 1394 bp, Homo sapiens
cctacccctcctcatctgcttcccatgagtggggccggggctgggtgagaggcccccagaagctgcccctgtgcacctcaccagcccgtcactcttcttctaaagtaacaaaaacaagtacctcagttctcacgggggctggggcccagggttgctgtgctgtctctctagttaccagggttggctccttcctctcagcctccttccggcaggaggttatatctgagagggaggaggagaaccatgtccagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataaaaaaaaaa

SEQ ID NO: 282880 - DNA, 2524 bp, Homo sapiens
  misc_feature (105)..(105): n is a, c, g, or t
ggagtttcggacacacagactggaattgaactaacgggcaccccaggaagactgtggggcgagacgaggaggatggggggaccagccgtcgccccactctcctgntcatcatcacagcctcgttggggtgtaaacgacccccagtaagctggtgcatgttcaatagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcgtgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcctgcggccgcagccttggagctcccagcgtcccctcggggttcaatcctccaggacctgtgtctgatgcctgcatgtgggtacctgggctccatcaggttctagatcggcctccgccctccactttcagggctccaggcccagcttctcatgtctgtggggagggtctccagagccttggtctgtggctgagctgtggaacttgaaggcctctctgcatcttgtcactcgtggcccctgcaccttgggtcatgacctgctttatgtggcaaccctgtgacagctgctaagtcctagaaaacacgtaacaggacgtgaggtgccctctgcgccgtgtgggcgcgtgcggggagacccgggccccaggacgtgaggtgccctctgcgccgtgcgggcgcgtgcggggagacccgggccacatgcgagcggggccccgagacattctgcactcgggaattgcggggattatcaaatcccgcttcagtgggaaacgtgagcgaaacccaaggtgagtggccgcagcctttcgtcacgtgctctcccgcatgtcctaagtgagggctcaggctgagctgccgttgccgagagccttgtgtctgcttcgggtgtctgcactgtgagtggctccgtgctggcgtcc

SEQ ID NO: 282881 - DNA, 868 bp, Homo sapiens
  misc_feature (772)..(772): n is a, c, g, or t
  misc_feature (775)..(775): n is a, c, g, or t
  misc_feature (783)..(783): n is a, c, g, or t
  misc_feature (787)..(787): n is a, c, g, or t
  misc_feature (868)..(868): n is a, c, g, or t
ttctctttggagaagtgtcttcatttttttctgttctccttccctgactgttgtggtctgatcctcccttgtcacacatgtgacttgagggtgttttctccctgcctgtcctttcacgcaccgagcgggggcctcacactttcctcacgtcccagcatctccccttgttctctgaggcacagatttttctgggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaaggttatggtnttncttttttntttnttttttttttattttttttctttttttctctttttttttttttttttgttgtgttcgctttttctttcttttgttcttttn

SEQ ID NO: 282882 - DNA, 827 bp, Homo sapiens
ctcgggtggcagtgagcggacagcgagggggacagacacaggtggaaggaaccacgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaaggacagtcatgagacaagcagtgtgtgtttaactagaaacagtgtccctttccaaaatgccctttaaggttg

SEQ ID NO: 282883 - DNA, 4437 bp, Homo sapiens
gcgaagacgttaggctaggtacgaggcctgggtggtgcatcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataaaaaaaaaa

SEQ ID NO: 282884 - DNA, 4065 bp, Homo sapiens
  misc_feature (3436)..(3436): n is a, c, g, or t
  misc_feature (3460)..(3460): n is a, c, g, or t
  misc_feature (3519)..(3519): n is a, c, g, or t
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgngtgtgtaggcacagtgcagatgtncgcacacacacacctccggcttggggccccaggcccgcactgtgctcacggatctgctntgcccaggttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282885 - DNA, 4092 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282886 - DNA, 4071 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggagtgaggctctgcttttcatgacttcctttccgattaagcctaagtagctcatgtattaaagaaaaagtcatcagacacagagatcagaattccaggaaatgatcttccagtgcgttctggccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282887 - DNA, 2720 bp, Homo sapiens
gtgaggacaaagagtggaggttggagttcagaattgtggacaggctcctgaggaccagcagaggctggaggccagggcttgccgccgggagtgtggctgtggaaagattccagtccacagtgggggctgctgcccagactcaccctgaataaagtgtcttcagagccacctgtcctgcctgttcatggcagtgacccagaaagattcatcagtgggcgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282888 - DNA, 2280 bp, Homo sapiens
gaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282889 - DNA, 2428 bp, Homo sapiens
  misc_feature (25)..(25): n is a, c, g, or t
  misc_feature (33)..(33): n is a, c, g, or t
ttaggctagtacgagctgggtgttnaatctggncgaggctgggctctggtccaggctttgtagaccgtgcaggcggctgcatccccgacctgacccaggcctgctcgctctggtgtgcaccgacctgccagctttgtggcactttgtggcatggggctcaggccgatggagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282890 - DNA, 2204 bp, Homo sapiens
ccacactgggctgccagagcacagtgaagggagcccccagggctgtggtgtcccggggctgtctcagcagcctcagaagttaggactttttttttgttaattgaatagccttcacatttgttgcttgtgcaggatctaattgagttaaagatttgggtttatattggtgggagccgggggagaccgtttgaaggaaaagatttaggggtaacaaaagaataaaagtttcccaaaatgtgatgtataaaaatttacagaatgctggtatttccctcaataagagcttacacaatttaacagccatgagaggaaggggccttagacttaacacaacgtggagaatgttcactttggcttttccacagattcctctcaaaggttaccatcgactttaagattagtattaatagaagctgtttttgctgttgtttttgatttcatggtgtttttgattgcctgggtacgctaacttgattttttgacagatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282891 - DNA, 1405 bp, Homo sapiens
atctagaggatcccgtgcctctagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282892 - DNA, 1163 bp, Homo sapiens
  misc_feature (1)..(1): n is a, c, g, or t
ntgtgatctagcggatcctttttgcggctgcctttcctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282893 - DNA, 729 bp, Homo sapiens
tcacagctccttctcccctcagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaa

SEQ ID NO: 282894 - DNA, 2583 bp, Homo sapiens
  misc_feature (2332)..(2332): n is a, c, g, or t
  misc_feature (2349)..(2349): n is a, c, g, or t
  misc_feature (2468)..(2468): n is a, c, g, or t
  misc_feature (2508)..(2508): n is a, c, g, or t
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaagatgcagcagtctcgaccctgtgnagctacagaaatgcatnaagccacgtgagtgggcctgttctttctgtcaatcatctggcatagagtatccattttgtgtccatcataggcaagtgcaagccttatataatgttaccaacatagatcacacctcagnatcttgcttgatgtgagtgctcatttttccatcaaacctntccacctacttcctccctccctccctttttgctgtgattcagtccatatattgggcatctagcatattccaggtc

SEQ ID NO: 282895 - DNA, 2661 bp, Homo sapiens
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacgctggcactagctgacagcttttcctctctgcacctgcgctctggtgacttggggtggacgcctctgccttcacttgaacacaaatgtgcttcctataaaatcatgtaccaagaa

SEQ ID NO: 282896 - DNA, 1553 bp, Homo sapiens
  misc_feature (1453)..(1453): n is a, c, g, or t
  misc_feature (1455)..(1455): n is a, c, g, or t
  misc_feature (1458)..(1458): n is a, c, g, or t
  misc_feature (1475)..(1475): n is a, c, g, or t
  misc_feature (1477)..(1477): n is a, c, g, or t
  misc_feature (1483)..(1483): n is a, c, g, or t
gggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgncnccngatcctgaagggctgancnagacanaagcgggcgccgcaacagggaccacttgacacccgccagaacagtgtgggcccgcgtccaagcccgaaca

SEQ ID NO: 282897 - DNA, 556 bp, Homo sapiens
aatgcacagcttctccgcggtcagcgggctggtctctttgagtttggaggccaggaacatgcagacagcacccaggagttgcagatgggacttcggagtcgggaccccagccaagaaacggtccagaagaatctaccataaaaccaacagactcctcctgatctctacctgtgctgtctgcctctctagttccggacactgagagctggtgccctgtggccacctcaagctggaaccctgcaagatcaccaagaagactgcatgcctcgctctagccttcctaagggaaagtagactcctgtttttgagagaaattacctgatttcaagagaaacataaaggactttttttcccttaacattccactcgtaaaaatgaagtttggaagaacttctgcaaactctgagtgttttggtcaattgaccttttactgtactaagcaaatctgaagccacaaatacattggggaggaaggtatacccttcacaaaagatccgtcacttagccagatactctgttgccatgcttctttaaataaagcacatttctggtatat

SEQ ID NO: 282898 - DNA, 6470 bp, Homo sapiens
gcagctgccgactggggatgacggcgggcaggaggagaccgcagccgaagggacacagacacgccgcttcaccagctcgcctcaggctgcccccctgcatttttgttttaatttttacggctttttcccctctctttcttcccttcctcctggtcccagcagagccaaggaaacccacaaaataagaaaggaagtgggccccggagcttggaacctccacagccggcttgtccagcgcagcgcgggggcgggaggctgcgcgcaccagttgccagcccggtgcgcggtacctttccttacttttcttgaaacagcgatcgtgcctgcatttggtggttttttggtttttgtttttttccttttcccgtatttgctgaatctccactatccgactttttttttttaatcttttctttccccccccccccaccccacctctttctggagcacgaatccaaacattttcccaagcaacaaagaaaagttcgcacgctggcaccgcagcccggacaggctggcgctgctgccgggcccccctccctccgacacttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacgctagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccactcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggccgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcaccgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttggtatgtcactttatatcccctggttctattaaaatatccatatatatttctataaaaaaagtgtttgaccaaagtaggtctgcagctatttcaacttccttccgtttccagaaagagctgtggatattttactggaaattaagaacttgctgctgttttaataagatgtagtatattttctgactacaggagataaaatttcagtcaaaaaaccattttgacagcaagtatcttctgagaaattttgaaaagtaaatagatctcagtgtatctagtcacttaaatacatacacgggttcatttacttaaaacctttgactgcctgtatttttttcaggtagctagccaaattaatgcataatttcagatgtagaagtagggtttgcgtgtgtgtgtgtgatcatactcaagagtctaaaaactagtttccttgtgttggaaatttaaaaggaaaaaaatcgtatttcactgtgttttcaatttatattttcacaactactttctctctccagagctttcatctgatatctcacaatgtatgatatacgtacaaaacacacagcaagttttctatcatgtccaacacattcaacactggtatacctcctaccagcaagcctttaaaatgcgtttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatgataaaatgtacacccccccatcaccaacctcacaacttagaaaatctaagttgtttgatttcattgggatttcttttgttgtgaaacactgcaaagccaatttttctttataaaaattcatagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagaaattgcttttaaaacaaataattgttttacaaaaccaataattatcctttgaattttcatagactgactttgctttcgacgtagaaatttttttttcttaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgcaaagagaattaggagagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttctttaaaaaaaaaaaaaaaaaagaattcgtctgaaaatgctcaggtttgtaagaatctaatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgtttt

SEQ ID NO: 282899 - DNA, 3203 bp, Homo sapiens
gcagctgccgactggggatgacggcgggcaggaggagaccgcagccgaagggacacagacacgccgcttcaccagctcgcctcaggctgcccccctgcatttttgttttaatttttacggctttttcccctctctttcttcccttcctcctggtcccagcagagccaaggaaacccacaaaataagaaaggaagtgggccccggagcttggaacctccacagccggcttgtccagcgcagcgcgggggcgggaggctgcgcgcaccagttgccagcccggtgcgcggtacctttccttacttttcttgaaacagcgatcgtgcctgcatttggtggttttttggtttttgtttttttccttttcccgtatttgctgaatctccactatccgactttttttttttaatcttttctttccccccccccccaccccacctctttctggagcacgaatccaaacattttcccaagcaacaaagaaaagttcgcacgctggcaccgcagcccggacaggctggcgctgctgccgggcccccctccctccgacacttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacgctagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccactcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggccgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacgaagttggagcagcagaagctgggaaccagagcttcattcttggaacattggcacatgctgtgtgtttcctgagacccaaataacctcagataaggaaactaatactaagtgagagaagatgtttgctgacagatgttcttgccctaagtcagtggcttctgaaacttggctgcattaaagtcacctgtg

SEQ ID NO: 282900 - DNA, 3959 bp, Homo sapiens
  misc_feature (3917)..(3917): n is a, c, g, or t
  misc_feature (3941)..(3941): n is a, c, g, or t
gcagctgccgactggggatgacggcgggcaggaggagaccgcagccgaagggacacagacacgccgcttcaccagctcgcctcaggctgcccccctgcatttttgttttaatttttacggctttttcccctctctttcttcccttcctcctggtcccagcagagccaaggaaacccacaaaataagaaaggaagtgggccccggagcttggaacctccacagccggcttgtccagcgcagcgcgggggcgggaggctgcgcgcaccagttgccagcccggtgcgcggtacctttccttacttttcttgaaacagcgatcgtgcctgcatttggtggttttttggtttttgtttttttccttttcccgtatttgctgaatctccactatccgactttttttttttaatcttttctttccccccccccccaccccacctctttctggagcacgaatccaaacattttcccaagcaacaaagaaaagttcgcacgctggcaccgcagcccggacaggctggcgctgctgccgggcccccctccctccgacacttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacgctagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccactcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggccgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcaccgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttgtctgtcctcccccacttcttgaataaaataatttaaagagaaaaaaaaanaaaaaaagtgcggcgaagcttatncccttagtggggtaattt

SEQ ID NO: 282901 - DNA, 1850 bp, Homo sapiens
ggcaattagcccaggacccacagccctggcgctccgcacgcacctcggtaacatcacagcaggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctcacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggggcgggcccggcagaacgaacaatcgccacggggggggcccgaacattaccgcgcccgcacggcctgtttgtatgaacgacgaggagaggggccacccaagagaggagtgggtgttatattaaaatggaacgagccaggccggccgccggatataaaacacgagggggagagtgggggagaaaaacgacgcctgctcggtggcttatggacggaagagcagcccacctacggcggggggggcacaaaagaggtggaggcccgctggta

SEQ ID NO: 282902 - DNA, 1720 bp, Homo sapiens
gcaacccattccctcccttcccccgcatagtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctcacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggggcgggcccggcagaacgaacaatcgccacggggggggcccgaacattaccgcgcccgcacggcctgtttgtatgaacgacgaggagaggggccacccaagagaggagtgggtgttatattaaaatggaacgagccaggccggccgccggatataaaacacgagggggagagtgggggagaaaaacgacgcctgctcggtggcttatggacggaagagcagcccacctacggcggggggggcacaaaagaggtggaggcccgctggta

SEQ ID NO: 282903 - DNA, 842 bp, Homo sapiens
gggctgccttttcacttttgtggctccaacctggcatacagcaggtgactaatacatgcttagtgaacaaaagacaacagctcccatttttttcaatacttgctcagggccaggccatggccagatgccttctctgtgaggagtggatgccatggtcatggtggacccctgtacatccaccttggtgctgtctccctgcattaactcctgcaggtccactttcccacagtcactgggatcttttgttttaatggaatcacattgcatcacccgttttcaggattgaaaacactcctgtggcctttcatgacactagggctaaaaccctcaggtcctcccttcctgcagctccttctacctcagacactgtgctgagggccccagccggtcagatctttctagtcatctagacccaggctcatggccacccctcagagaggccctccatgctggcccattccaaacgcttgcattattcctaggaaagggatgtactggtacagcatgagggtgtttgtgacctgtgccctttggccagaccctgacacagtgccttggtcataccctgcacttggtcataccctccagtccagagactggacacagtagggctacatcaaatattatagatgaatgcatggatgggcgatagagttaagagtcggggcctcagctcctggaggtccttgctctgccggacacacttatctttgaaattctgacttccaggtcgtctctacggacttcctcggtgatacccactcgtccatcttcgatgctaaggccggcattgcgctcaatgacaatttcgtgaagctcatttcatggtaagggggaaggag

SEQ ID NO: 282904 - DNA, 492 bp, Homo sapiens
acccctcagagaggccctccatgctggcccattccaaacgcttgcattattcctaggaaagggatgtactggtacagcatgagggtgtttgtgacctgtgccctttggccagaccctgacacagtgccttggtcataccctgcacttggtcataccctccagtccagagactggacacagtagggctacatcaaatattatagatgaatgcatggatgggcgatagagttaagagtcggggcctcagctcctggaggtccttgctctgccggacacacttatctttgaaattctgacttccaggtcgtctctacggacttcctcggtgatacccactcgtccatcttcgatgctaaggccggcattgcgctcaatgacaatttcgtgaagctcatttcatggtaagggggaaggagctggagacttagagggaggggaactaaggggtggtcggaaggaacccccttgaacctcccgacccctcctccacag

SEQ ID NO: 282905 - DNA, 399 bp, Homo sapiens
tacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctcacggctgcgtcccgtatctctgcgccggtcagggcgggttctgatccgggtttgaggcccgccccacccttactcgatcgcctgcgcccacgggcgaggggtcgcgctcgactccaagccgggttccacttcaggagaccgggaccgcgatggcagcggtagaggccccgcatggccggaagtcactccccaaagcgct

SEQ ID NO: 282906 - DNA, 447 bp, Homo sapiens
aggtgggccggtacctgctcagcctgtcaaatggtgaaagccatggactatgaaggtggggctcaagcaggggagactgactcagccctgccacttccccacagcaaagagcccaaacagatcccctggagggctgtcgggagcccctacgtggtggagtccacaggcgtgtacctctccatacaggcagcttcggtaagctggggagaggtgcccagggctagctggggggatgatggtgccagaagcccctgacacctgcgcttcctccccaggaccacatctctgcaggtgctcaacgtgtggtcatctccgcgccctcaccggatgcaccaatgttcgtcatgggtgtcaatgaaaatgactataaccctggctccatgaacattgtgaggtaatgtgggcagtgacatcctgcaatgtgtggaagggagggtagactcgtcc

SEQ ID NO: 282907 - DNA, 448 bp, Homo sapiens
gcaacctagtgagcctggaggaggacctgaaggaaggggcttcccgggcccagaccatgggcaactccctactgaaggagcgagccatatatgtcctcgttcggatcatcagtaagagggagaggacatggcctccacccgctatgagtccctattggagaacctggatgaccattacccagagctggcagaggaactgcgcaggctgtcaggcctctcctctgtgggccacaactggaggaagcgtatgggcactcgcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgcaaaaatgt

SEQ ID NO: 282908 - DNA, 2572 bp, Homo sapiens
  misc_feature (362)..(362): n is a, c, g, or t
  misc_feature (2555)..(2555): n is a, c, g, or t
  misc_feature (2557)..(2558): n is a, c, g, or t
  misc_feature (2565)..(2567): n is a, c, g, or t
  misc_feature (2569)..(2572): n is a, c, g, or t
cctctttcgaaccctgtaggattttacttcttgacgcatctgtttatttaaaccaaaggggtatgttgaggcatgggcaccctggcagcagaccccaaaccaaccctcttgacttgtgcctgccttcaggatatgttccttcctgaattgtctaagaaggctgagttggggggtggttgctgatttttataacatatagcagttgttcataggcctgtgttttaaagaagggcaagcctgaactaccgtcctgcctaggcctggctccatacctgggagtagacagtcttctactttctaaaaactgacttaaatttgataaatctcctgttgagtgacagtgtttcgcagctgagcccttnaggagattctcagttgggcagagacatcccttcctcagacgccttgtgggctggactcctttggcccagttcaaagtgaggggagggctccaacaggccgggaagacagttgacttcaccctccttgggtttgtctgtctgtccgtctctgggaatggtcgcttcctgttttcccttttccttttaagcctcgccttgttccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaaccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctcngnntccggannnannnn

SEQ ID NO: 282909 - DNA, 2894 bp, Homo sapiens
  misc_feature (362)..(362): n is a, c, g, or t
  misc_feature (2877)..(2877): n is a, c, g, or t
  misc_feature (2879)..(2880): n is a, c, g, or t
  misc_feature (2887)..(2889): n is a, c, g, or t
  misc_feature (2891)..(2894): n is a, c, g, or t
cctctttcgaaccctgtaggattttacttcttgacgcatctgtttatttaaaccaaaggggtatgttgaggcatgggcaccctggcagcagaccccaaaccaaccctcttgacttgtgcctgccttcaggatatgttccttcctgaattgtctaagaaggctgagttggggggtggttgctgatttttataacatatagcagttgttcataggcctgtgttttaaagaagggcaagcctgaactaccgtcctgcctaggcctggctccatacctgggagtagacagtcttctactttctaaaaactgacttaaatttgataaatctcctgttgagtgacagtgtttcgcagctgagcccttnaggagattctcagttgggcagagacatcccttcctcagacgccttgtgggctggactcctttggcccagttcaaagtgaggggagggctccaacaggccgggaagacagttgacttcaccctccttgggtttgtctgtctgtccgtctctgggaatggtcgcttcctgttttcccttttccttttaagcctcgccttgttccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctcngnntccggannnannnn

SEQ ID NO: 282910 - DNA, 2930 bp, Homo sapiens
  misc_feature (362)..(362): n is a, c, g, or t
  misc_feature (2913)..(2913): n is a, c, g, or t
  misc_feature (2915)..(2916): n is a, c, g, or t
  misc_feature (2923)..(2925): n is a, c, g, or t
  misc_feature (2927)..(2930): n is a, c, g, or t
cctctttcgaaccctgtaggattttacttcttgacgcatctgtttatttaaaccaaaggggtatgttgaggcatgggcaccctggcagcagaccccaaaccaaccctcttgacttgtgcctgccttcaggatatgttccttcctgaattgtctaagaaggctgagttggggggtggttgctgatttttataacatatagcagttgttcataggcctgtgttttaaagaagggcaagcctgaactaccgtcctgcctaggcctggctccatacctgggagtagacagtcttctactttctaaaaactgacttaaatttgataaatctcctgttgagtgacagtgtttcgcagctgagcccttnaggagattctcagttgggcagagacatcccttcctcagacgccttgtgggctggactcctttggcccagttcaaagtgaggggagggctccaacaggccgggaagacagttgacttcaccctccttgggtttgtctgtctgtccgtctctgggaatggtcgcttcctgttttcccttttccttttaagcctcgccttgttccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacagtggccctctcacccttcactgtaacacgccgtataggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctcngnntccggannnannnn

SEQ ID NO: 282911 - DNA, 965 bp, Homo sapiens
cggctaaggcagattctgcgatcgtccctacaagactaggaggcggggttcggcaaaggcccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggaggaagatcttggcttgaaggcggctgatgccggaaggacgggatctacgtgacgtggccacatggtcggagcggctgctcgcccggagttcaaaacaccgaggcctacaatggagacagggccatatcaggccgggtgggacctgaaaactggaggagggagaaaggatcatacataacccacaaggtccagggccaaaccggtgctcccgacaaaccgccagggaacccgccaaaagccccgg

SEQ ID NO: 282912 - DNA, 2719 bp, Homo sapiens
tcgcagagccccaatgaatgggggagccggaagcaggaagtgagtttgcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282913 - DNA, 2683 bp, Homo sapiens
cgcgggttaattggacaggaaggagcagtgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282914 - DNA, 2655 bp, Homo sapiens
tggctaggtaggaggccgcgttgaaattcggagaggtgccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282915 - DNA, 2693 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataatataggccggcgggggggggggg

SEQ ID NO: 282916 - DNA, 2621 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282917 - DNA, 1786 bp, Homo sapiens
cggctaaggcagattctgcgatcgtccctacaagactaggaggcggggttcggcaaaggcccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282918 - DNA, 1248 bp, Homo sapiens
gaatctagaggatcccgattcgacggaagcagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282919 - DNA, 1524 bp, Homo sapiens
  misc_feature (1514)..(1514): n is a, c, g, or t
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcgtggggttgtaagngggatcctca

SEQ ID NO: 282920 - DNA, 1454 bp, Homo sapiens
cttgtaataaacggggatatttatgctgtcggccggaagaccgggatcggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282921 - DNA, 1425 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282922 - DNA, 413 bp, Homo sapiens
tcgcagagccccaatgaatgggggagccggaagcaggaagtgagtttgcgaacggagcagctgctgcagcagggcccatggcggacacccagtacatcctgcccaatgacatcggcgtgtctagcctggactgccgtgaggcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282923 - DNA, 330 bp, Homo sapiens
tacccggtccggcgcttgtgcggcctgctgacaaaaggccgagcccgcagggccaatccgcgcgccaccccgtagcgcctgggggcgggagcgggcgagccgagaagctcgtcttggcgcgtctattggctggtactgacgcccatccggaccccgaggccaggcagttggccaaggggggcggggttcgcagagccccaatgaatgggggagccggaagcaggaagtgagtttgcgaacggagcagctgctgcaggtgaggcgcggcgcctgggcttttggggtcaaagcgtgtcatcccgggggaccaaggcgaatccatactgagcg

SEQ ID NO: 282924 - DNA, 924 bp, Homo sapiens
aaaacgcagctggtacggtctgggatgtttggatgctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatctcaaagctgggcgcgcggaaagccagcctgtcgcaaagcccggcacatggcccttacaaccccccggcccggccaaagggcccggccagaacgccccgggtccccaccac

SEQ ID NO: 282925 - DNA, 2711 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282926 - DNA, 2714 bp, Homo sapiens
cttgtaataaacggggatatttatgctgtcggccggaagaccgggatcggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282927 - DNA, 2586 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcaggatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282928 - DNA, 2700 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcacccaaccgagtcactacagcgatgattgaagtgagtaaccaccccgaggatcggataaatatctatgaacagcagtt

SEQ ID NO: 282929 - DNA, 1808 bp, Homo sapiens
tgacccaggcccagggagaaggggcaggcggccaggggcctgagggagagacgggtttgtgcagctgcatctttcctgtccaggtcctgacccagtagggcccaggcctgggtcactgctatccccatcttccagcccagggtgactgcatacagtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282930 - DNA, 1227 bp, Homo sapiens
tggcaccctaagcccgacagtggagctccttttccagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282931 - DNA, 1482 bp, Homo sapiens
ccatggctggatcgaggccgggggttgaatcggcacgaggcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282932 - DNA, 1364 bp, Homo sapiens
cttgtaataaacggggatatttatgctgtcggccggaagaccgggatcggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccaaaaaaaaataatataaaaaaaa

SEQ ID NO: 282933 - DNA, 450 bp, Homo sapiens
gcatgtggcaggaactgaaaccgcagctggtacacctggaatttgttctgtttttcttccatacagaaggactcctggacgtcaattttctgcaacacctggaaccagacggacagagagaacttgacttgttcaggtcctaggtgactgcgcaatgtgagtgggttacgagacccaagggtttacagagatagcagctgaacctcctaggagtggcctcagcagagcggggaacaaactgaaaccacctcctgctatcccccacctgcctttgctgacacctgtaaagctgccaacccgcctctgcacatacctgcatcgtgttcacagttgaacctttggctcccgactgcaccatcatctgcaggctgttctctgggaactgtctgtgtaggccaaaaggcatgcatgcctgcagattaaatcagcacagtggtcagtgacttcacc

SEQ ID NO: 282934 - DNA, 3386 bp, Homo sapiens
agcaggctggtactggtctggggtttatggatcgccgcgtgcacagccggcgctcgttccagcggcctcgcgcgcgccgccgccctgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccagccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcaggtaaagtggcaggaacgtcttccgtctgctcagcgtttggggatttagactcctaaagccagtacctgccccgtttcccccccaggttccgtcctgcccgcgcccggtctcagggtggcggccccggacacggcccgtccccacagacgaggtctccggcctgagctgtcgcacctggcgcggaggtcgcccggggtgccctggctgggtgagaggtggcctggcgggcggagcttgccaagaatcacggccagtccttaagtggatggtggggcccagcagctgctctgtcccccttaacaaaccagggggcatggaggggcccagggcaccgcccccctaccaggctcaggccctccaaggagaacctgctgagacccctgagcctgtcctagaccccggacccctgacccttcccaccccttccagcgtcccagggcgaggccttggacagagctcctggtcctctgcagggagaccatccagcccaagctctgggaggcacagtccattgagtgggcggaggccgcggggtgctgagccggggagggtgctcggagtccatccatccctcagacggcaagtcccacagggtccaacccacctgaaacctgcctgcacggtggaagtggtggaggtggacactcctaggggcttttctaaagctagactcgcagctccttgctcaggaaaattaaactattcacgtttcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcagtgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaattttgtgtaattctaatcacaaaatgacgtgccttaagtgcccctccagctgtgggttggcagtgtccagacagggagggcccatcaccgaaatcctgaacgattactagaccaattctattaaaaacatttcaaggcattttgggtgcaaactttgtttataaaagagaaatatccacctatgagaatttaaggagacgtctcctgtaggcagacatcgctctgcccaaaaattagcactgacacatgcgtgtgtgtgcgcgttgtgtgcgtgtgtgcgtgcacgtgctgttgctgcccttcctagctggtgtgaggaagccactggacacagctgtggcgcgacccctggatctgagcacagcccctccggtgcagacagatggggtcagagccccctgcggaggcctgtcattgcaggcacccgtgaggaggatgtgaccagtgaccgtgggtcccagcggtgaccctcacacagaatcagagcaaaacaccagtgagggctgcacactcaccaccattcgccctgggcactcattccagaagtaacaagaattccctctcagtgggaaaataaatgcatttttcattcttataagggacactctaatgactgtgaacactacgaattctaattcatatgcatttactgagcacttactgtatgccaggtgcactcaagacctgctgctaagtgggaagctgggttcagaggcacatggaacagctcgcccgctggatgccctgggaagagctacctcttctgagcccctgatgcttgttaagagctgcttctacttctcagttacttctcaagttttgattctttcaagaagtcccatttgtgaatttttcacatcttgtgaggatgaaataaaagcaaaatgtcaactctgccatctc

SEQ ID NO: 282935 - DNA, 1531 bp, Homo sapiens
  misc_feature (18)..(18): n is a, c, g, or t
agatggtcaggctgtacnggtccgagtctttgggatagctccttgctcaggaaaattaaactattcacgtttcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcagtgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaattttgtgtaattctaatcacaaaatgacgtgccttaagtgcccctccagctgtgggttggcagtgtccagacagggagggcccatcaccgaaatcctgaacgattactagaccaattctattaaaaacatttcaaggca

SEQ ID NO: 282936 - DNA, 2248 bp, Homo sapiens
agcaggctggtactggtctggggtttatggatcgccgcgtgcacagccggcgctcgttccagcggcctcgcgcgcgccgccgccctgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccagccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcaggtaaagtggcaggaacgtcttccgtctgctcagcgtttggggatttagactcctaaagccagtacctgccccgtttcccccccaggttccgtcctgcccgcgcccggtctcagggtggcggccccggacacggcccgtccccacagacgaggtctccggcctgagctgtcgcacctggcgcggaggtcgcccggggtgccctggctgggtgagaggtggcctggcgggcggagcttgccaagaatcacggccagtccttaagtggatggtggggcccagcagctgctctgtcccccttaacaaaccagggggcatggaggggcccagggcaccgcccccctaccaggctcaggccctccaaggagaacctgctgagacccctgagcctgtcctagaccccggacccctgacccttcccaccccttccagcgtcccagggcgaggccttggacagagctcctggtcctctgcagggagaccatccagcccaagctctgggaggcacagtccattgagtgggcggaggccgcggggtgctgagccggggagggtgctcggagtccatccatccctcagacggcaagtcccacagggtccaacccacctgaaacctgcctgcacggtggaagtggtggaggtggacactcctaggggcttttctaaagctagactcgcagctccttgctcaggaaaattaaactattcacgtttcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcagtgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggttgtatgccaggtgcactcaagacctgctgctaagtgggaagctgggttcagaggcacatggaacagctcgcccgctggatgccctgggaagagctacctcttctgagcccctgatgcttgttaagagctgcttctacttctcagttacttctcaagttttgattctttcaagaagtcccatttgtgaatttttcacatcttgtgaggatgaaataaaagcaaaatgtcaactctgccatctc

SEQ ID NO: 282937 - DNA, 855 bp, Homo sapiens
agcaggctggtactggtctggggtttatggatcgccgcgtgcacagccggcgctcgttccagcggcctcgcgcgcgccgccgccctgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccagccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcagaaagatttttcaacactgcttttataaatctttgttccggcccaaccagaggggagaccgtggagagctcaagaccccgtttttccacgtttaaccagcgagatgatgggacggaggtgacgcggctgcagccatggaggtggccccttggggaagtggcaggtgccctgagacaggggccgcaaaggctggcctggggcctggagccagcatggtggaggggggacgtgcgtgggtccccttccctggacctggtactggggactccctgtaatcacgtcctcggaaggtgtctggtccaagctgcacttgggccctcccgagtccaccatgagcacagaggaaacttcctaaactcgccccactgaggccactccacagcccaaatcttccccaccacaca

SEQ ID NO: 282938 - DNA, 2622 bp, Homo sapiens
agcaggctggtactggtctggggtttatggatcgccgcgtgcacagccggcgctcgttccagcggcctcgcgcgcgccgccgccctgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccagccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcaggtaaagtggcaggaacgtcttccgtctgctcagcgtttggggatttagactcctaaagccagtacctgccccgtttcccccccaggttccgtcctgcccgcgcccggtctcagggtggcggccccggacacggcccgtccccacagacgaggtctccggcctgagctgtcgcacctggcgcggaggtcgcccggggtgccctggctgggtgagaggtggcctggcgggcggagcttgccaagaatcacggccagtccttaagtggatggtggggcccagcagctgctctgtcccccttaacaaaccagggggcatggaggggcccagggcaccgcccccctaccaggctcaggccctccaaggagaacctgctgagacccctgagcctgtcctagaccccggacccctgacccttcccaccccttccagcgtcccagggcgaggccttggacagagctcctggtcctctgcagggagaccatccagcccaagctctgggaggcacagtccattgagtgggcggaggccgcggggtgctgagccggggagggtgctcggagtccatccatccctcagacggcaagtcccacagggtccaacccacctgaaacctgcctgcacggtggaagtggtggaggtggacactcctaggggcttttctaaagctagactcgcagctccttgctcaggaaaattaaactattcacgtttcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcagtgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaattttgtgtaattctaatcacaaaatgacgtgccttaagtgcccctccagctgtgggttggcagtgtccagacagggagggcccatcaccgaaatcctgaacgattactagaccaattctattaaaaacatttcaaggca

SEQ ID NO: 282939 - DNA, 1908 bp, Homo sapiens
agcaggctggtactggtctggggtttatggatcgccgcgtgcacagccggcgctcgttccagcggcctcgcgcgcgccgccgccctgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccagccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcagtgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaattttgtgtaattctaatcacaaaatgacgtgccttaagtgcccctccagctgtgggttggcagtgtccagacagggagggcccatcaccgaaatcctgaacgattactagaccaattctattaaaaacatttcaaggca

SEQ ID NO: 282940 - DNA, 1153 bp, Homo sapiens
agcaggctggtactggtctggggtttatggatcgccgcgtgcacagccggcgctcgttccagcggcctcgcgcgcgccgccgccctgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccagccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcaggtaaagtggcaggaacgtcttccgtctgctcagcgtttggggatttagactcctaaagccagtacctgccccgtttcccccccaggttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaattttgtgtaattctaatcacaaaatgacgtgccttaagtgcccctccagctgtgggttggcagtgtccagacagggagggcccatcaccgaaatcctgaacgattactagaccaattctattaaaaacatttcaaggca

SEQ ID NO: 282941 - DNA, 1308 bp, Homo sapiens
cggccgccggcagggttcgcgaggcacccacgctcctaaaaagagcacgacgcacccgatgctcggattggatgaagtgcaaagctttaatccctggaaaggccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagagagtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattattagaaagggcaggtgtaccgatatgtttatgcccattcttcttgtgtacttgtgactcttagcagcatggaagagaagtgtaaccatgcaaatacaatgagcttaatatgctaactgt

SEQ ID NO: 282942 - DNA, 810 bp, Homo sapiens
cgcccgggctgtccgccgcgcggggaggacgcgagcacccagctttaatccctggaaaggccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtaagttgtgaaaacttaagaaaaacgagttgaattaagttgtgaagaacttcattctccttgtcaacatgtgagcagcctcaaagagtatccttatggatcctcttctcgccagtatctccattaggtttctccacacatacaatcaaggtga

SEQ ID NO: 282943 - DNA, 730 bp, Homo sapiens
actagtacgaggctggtgttaatcggccgtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282944 - DNA, 1814 bp, Homo sapiens
gggctgccacttggactcccttgccagggggcgggcaggggctggctctgcctggggccaggcccatgttaacctgtgccccggcctgggggccagaggggcaggcctgcgcacggggaggctgttgtggcagcggaacagagacgtgcacgagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282945 - DNA, 2060 bp, Homo sapiens
  misc_feature (5)..(5): n is a, c, g, or t
ccccncctcacccactgcctctgcctccctggggcagagctgttcccagacgggtggggcggggcccaactgtcccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282946 - DNA, 1927 bp, Homo sapiens
  misc_feature (5)..(5): n is a, c, g, or t
ccccncctcacccactgcctctgcctccctggggcagagctgttcccagacgggtggggcggggcccaactgtcccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282947 - DNA, 1821 bp, Homo sapiens
tgtacgcgcggaattatgggatggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282948 - DNA, 1403 bp, Homo sapiens
cttcacctgtacttcccatcctgtcctgcccgagtccaggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282949 - DNA, 466 bp, Homo sapiens
atccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctga

SEQ ID NO: 282950 - DNA, 884 bp, Homo sapiens
caggcggctagcggggagagaggggaaagtctggggcccactgtcccaaggcagggagctgactctaggcataaggaggaaaagccccagatggaaggggtggaagggggctatgctgcacagaggaccgagggtggtcgctcacccaggcaggtagctctcgatgactcatatagagagttttcgcagtgagctgctcctcgtcgtccagtagctgcctcgctgctcgaaggctccgttctttctcgtcgcggacccggcgccagcccaggtagagggcgaggccgaagagcacgaaacccacgctgagtcccactgccccggccaaatacacagggtatttttttcttctaaaaccagtgctggaacctgtgctgtgcagaagagaggacaagacgagggatgttcccaaattcccataagaggacacagcccctcagtcagtccttcctctctgctggcttcagtctgcactcctctgcaagcccccactgtgaggcttgaagatggacaagaggaccctcataaaagggaggtgacggaacttgcacttggctcctctctgacagtcacccttgagaaagtcacggcagatagggacctcctccttgccatttggtaggtcagccggtgaaaggccaaggccagctgctactttctgcctcagccgtgggggaagctctcctgtcttcttatagccatcctcatcctccttggagccatggatgaaacggcaatttgggcggctacactccttgttctggaagtcatggcagaagatgaactcgtttttgctcacccccaagttggacacctcgctcatgtctgggtggcgatatcggcaacgcttgcctcgcttgcacacattcctcaagaagtctcta

SEQ ID NO: 282951 - DNA, 345 bp, Homo sapiens
cgtaagacatgcctttcaccttccgccatgattgtgaagcctccccagccacgcggacctgtgagtccatcgaacctatttttctttataaattacccagtctcaggtacatgccttcagctgaacgagaccttgagcagcatgaagacataattccttctggatgttgtgccgaatttcatgttgagcagagtattcaaagtactatggaaggaatagcactgttactgacaaaagcaacccatgtgctcagttgcaaaataaataaataaatcagcaactcgttaaataataaagtcatttctatttcaacaaaataatacaataaaaatagttattagaaac

SEQ ID NO: 282952 - DNA, 3820 bp, Homo sapiens
  misc_feature (1336)..(1336): n is a, c, g, or t
  misc_feature (1452)..(1452): n is a, c, g, or t
  misc_feature (1549)..(1549): n is a, c, g, or t
  misc_feature (1604)..(1604): n is a, c, g, or t
  misc_feature (2350)..(2350): n is a, c, g, or t
  misc_feature (2379)..(2379): n is a, c, g, or t
  misc_feature (2383)..(2383): n is a, c, g, or t
  misc_feature (2389)..(2389): n is a, c, g, or t
  misc_feature (2421)..(2421): n is a, c, g, or t
  misc_feature (2424)..(2424): n is a, c, g, or t
agtcaccgatgctggaagggtttctttggccctgagtgaagagagacccagagggaacactgaggtgcctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgngaggccagggtgggtggatcacttgaggtcaggagttcaagactagcctggccaacatggtgaaaccccatctcgactaaaaatacaaaaattagccaggcgtggtggtgcacacntgtaatcccagctactcgggaggctgaggcaagagaatcacttgaacccaggaggcggaggttgcagtgagccaagatggtgccgctgcactccagnctgggtgacacagcaagactccatctcaaaaaaaaaaaaagaaaaagaaatgaangggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttgagatggagtcttgctgcatcccccaggctggagtgcagtggcatgatcttggctcactgcagcctccgcctcccaggttcangcgattctcctgcctcagcctcccgagtngctnggattncaggtgcgtgccaccacgcccagctaattttntangtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcagaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatgggagaaaaggttctctgagaacgtattacataagtatcacatgaactccaaaatacatcttaggccaggcatggtggctgtaatcccagcactttgggagggtaaggcgggcagatcacttgaggtcaggagtccgagactagcctgggcaacatagtgaaaccctgtctctactaaacatacaaaacattagccaggggtggtggtgcagacctgtagtcccagctacttggcaggcttaagcaggagaatcgtttgcaccagggaggcagaggttgcagtgagccaggatcacaccattgcactctagcctggacaacagagtgagactccatctcaaaaaaaaaaaaaaaattcttaagagtagatggaatcctattacaagtctggatcaaaaaggcagctttggctgggtgcagtggctcacacctgtaatcccagcactttgggaagctgaggcagatggatcacttgaggttaggagttcaagaccagcctggccaacatagtgaaaccctgtctctactaaaaatacaaaattagctaggcgtggtggtgcatgcctgtaatcccagctgctagggaggctgagacagaagaatcgcttgaacctgggagatggaggttgcagtgagctgagatcacaccattgcactgcagcctgggcaacaagagcgaaacttggtcaaaaaaaagaacaaggcaacttttacaacgattttttagatctcaat

SEQ ID NO: 282953 - DNA, 1788 bp, Homo sapiens
agtcaccgatgctggaagggtttctttggccctgagtgaagagagacccagagggaacactgaggtgcctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcagaggaataattttttttaatcaccgtgattggacttgcgaatagccactgcactgcggcctggacgacgtagtgataccctgactcttataaataaataaatgaataaacac

SEQ ID NO: 282954 - DNA, 374 bp, Homo sapiens
agtcaccgatgctggaagggtttctttggccctgagtgaagagagacccagagggaacactgaggtgcctgcccaaccactctgtcccggtttccttcagcaggaccaggtccttccttgtctccttcccctcagcagtttctatgaaccaccctggcagtaatggtgcagatggctcgcgcacagctggtggtgacccgactttcctgcctccaccctggggctcctcagaggcttcatggaacccaaactgctggtctcacctccgagccctgccgtcgcccagggagggcggctccgtccctcctgcactccctaatcccgctctgaatcaccgcttctgttctgggtcggagaataaaggtggggtttcc

SEQ ID NO: 282955 - DNA, 1406 bp, Homo sapiens
gcccaggctggagtgcaatggcacgatctcggctcaccaccacctccgcctcccgggttcaggtgattctcctgcctcagcctcctgagtagaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcagaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatgggagaaaaggttctctgagaacgtattacataagtatcacatgaactccaaaatacatcttaggccaggcatggtggctgtaatcccagcactttgggagggtaaggcgggcagatcacttgaggtcaggagtccgagactagcctgggcaacatagtgaaaccctgtctctactaaacatacaaaacattagccaggggtggtggtgcagacctgtagtcccagctacttggcaggcttaagcaggagaatcgtttgcaccagggaggcagaggttgcagtgagccaggatcacaccattgcactctagcctggacaacagagtgagactccatctcaaaaaaaaaaaaaaaattcttaagagtagatggaatcctattacaagtctggatcaaaaaggcagctttggctgggtgcagtggctcacacctgtaatcccagcactttgggaagctgaggcagatggatcacttgaggttaggagttcaagaccagcctggccaacatagtgaaaccctgtctctactaaaaatacaaaattagctaggcgtggtggtgcatgcctgtaatcccagctgctagggaggctgagacagaagaatcgcttgaacctgggagatggaggttgcagtgagctgagatcacaccattgcactgcagcctgggcaacaagagcgaaacttggtcaaaaaaaagaacaaggcaacttttacaacgattttttagatctcaat

SEQ ID NO: 282956 - DNA, 3067 bp, Homo sapiens
  misc_feature (1336)..(1336): n is a, c, g, or t
  misc_feature (1452)..(1452): n is a, c, g, or t
  misc_feature (1549)..(1549): n is a, c, g, or t
  misc_feature (1604)..(1604): n is a, c, g, or t
  misc_feature (2350)..(2350): n is a, c, g, or t
  misc_feature (2379)..(2379): n is a, c, g, or t
  misc_feature (2383)..(2383): n is a, c, g, or t
  misc_feature (2389)..(2389): n is a, c, g, or t
  misc_feature (2421)..(2421): n is a, c, g, or t
  misc_feature (2424)..(2424): n is a, c, g, or t
agtcaccgatgctggaagggtttctttggccctgagtgaagagagacccagagggaacactgaggtgcctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgngaggccagggtgggtggatcacttgaggtcaggagttcaagactagcctggccaacatggtgaaaccccatctcgactaaaaatacaaaaattagccaggcgtggtggtgcacacntgtaatcccagctactcgggaggctgaggcaagagaatcacttgaacccaggaggcggaggttgcagtgagccaagatggtgccgctgcactccagnctgggtgacacagcaagactccatctcaaaaaaaaaaaaagaaaaagaaatgaangggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttgagatggagtcttgctgcatcccccaggctggagtgcagtggcatgatcttggctcactgcagcctccgcctcccaggttcangcgattctcctgcctcagcctcccgagtngctnggattncaggtgcgtgccaccacgcccagctaattttntangtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcagaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacac

SEQ ID NO: 282957 - DNA, 1881 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgca

SEQ ID NO: 282958 - DNA, 666 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagatttctttaccccttctcccctagtttctatcccttccttcctctatacttacaggggcgctattttgatattttttt

SEQ ID NO: 282959 - DNA, 796 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaaggtaaggtgatttcatacatagttaaataaaatcaaactatttaatagaaaataaacacatatgtgtgtttgaacacatacaatgttctcatctgtcagtcataagtcaaacatagggtttaatgcctcatggcaaatacggaaaaattaaattgcaaagttagattttaaatcacacctagcaattattgtctctgtaattttgtcttatggtgcatattggaacatttacatctgtaagtgaagtttgagttcagttcaacttcaagaaaatcaatttagtggtctctgagtgtttgttattataaaatcttcttgcatgtttttaatgactatgagattgtcaacgtctattgaacagtctactgaatgaattttatctcttaagtaattagctcttcaaaatagagttataagaaggttgtaaaatggaaatgttatggttaaatataagacttttctcatttttgaatgttaaatcatgatagctcgttgtaaagatgtatatttgctattctctcgaactaatgttattactacacaaaaaatcgggctgtgttttgagaagcatcaaaacaccatatactggtagacttgacaaattggtaatatgtggaatgttactctgttctttgtcttggcaataagtgctactttt

SEQ ID NO: 282960 - DNA, 899 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagtggccattgatgatcattgcctggatccaacattgcattaggggtttgcaaaatgcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaagaggtaaatattctctgataatcatttgtatttttctactaaaactttcttaaactattcagctagactatagaagtgcttggtactttatgaagtacttaagcatttgttttcttcctcagtcattatgcccagaacttgggtggaaggaagtattactttcattttaacagaagaaactgacactcagaaagatcatgcatctgctgggtgcagtggctcacacctgtaatccgagcactttggaggccgtggcgggaagatcacctgaagtcaggagttcaagaccagcctggccaacatggtgaaaccccgtctctactaaaaatacaaaaattagctgagcatggtggtgcacgcctgtagtcctagctactcaggaggctgaggaaggagaatcgcttgaacccgggaggcgggggttccagtgagccctgattgcaccactgaacttcagcctggcaacagagcaagatggcgtctc

SEQ ID NO: 282961 - DNA, 1836 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgca

SEQ ID NO: 282962 - DNA, 1580 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgca

SEQ ID NO: 282963 - DNA, 161 bp, Homo sapiens
atacaagtgaagttaagtaaaagttctattggcacctttggtccccatgtgcatctctatactttctttaaatctaaagagaactaaaaataaaatatttgaatctgactaatttgctttatattttttgtcttacaggaatacacctcaacacttttgct

SEQ ID NO: 282964 - DNA, 498 bp, Homo sapiens
aagatggagagaatgcccacccatatagaaacagtgaccctgtgattgggacccacacagagaaggtgtccctcaaagccagtgactccatggatagtctctacagtggacagagctcatcaagtaaggctaatgaatcagggacaagatcctgggtgtgaggtctgggttaaattaattaaaaaacaacaagttaaatcagccacaaggttccagctacttgataagagaaatggtaaaaatgtaagatatattaaatctatatagagttgctattgtttaaataatacataatatatttgacacagtcatatagtgtgtgaaaacttttaacactgtagtcaacggggctcctcgggatactcctcaaaaaagccatattaggagattaaacctgcatctttaaaataaacacctttgttggagtgagccacctttatcttgagtcaacatatttcaaaatgacttgaagtattcagataaatgaaatttattttc

SEQ ID NO: 282965 - DNA, 2178 bp, Homo sapiens
  misc_feature (76)..(76): n is a, c, g, or t
  misc_feature (233)..(233): n is a, c, g, or t
  misc_feature (365)..(365): n is a, c, g, or t
ggaagctcagcagtgtccactgtcgccattccttggccatagaaaacaatgtatttgaattttgatgtaagcatancaaattgaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaatnactgcaacttggaagataaattagcttggtatgaaggtgaagcttacatgtggcatcactggaagccttttcctgaaaaccctctctggacatgtcttgatttccaaatagcacaagttggaccctgggacnactgctcctcttgtattcgccacacacgtctcaagtcttcctgctcagatatggatctcctacattcatggcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgca

SEQ ID NO: 282966 - DNA, 1833 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgca

SEQ ID NO: 282967 - DNA, 1407 bp, Homo sapiens
ctcgcgtcacagtgacagccaccgttgcctggggacgggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggaattatccgatgaaaagtagaagaggttgaatgactttcagtggccttttcttcacagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282968 - DNA, 1260 bp, Homo sapiens
ctcgcgtcacagtgacagccaccgttgcctggggacgggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggaattatccgatgaaaagtagaagaggttgaatgactttcagtggccttttcttcacagattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282969 - DNA, 1585 bp, Homo sapiens
agcgggtgtggcagtgcgtcccctctccgcgggatcgtcgccatggtcctgcgatcctaggagtcgggcaaggccgaacctgcctgaagaaacctcaagcggagattcaaggaagcaccacgtgatccctaaggatcccaaagatgcgtcgggcatgcatgggcggtgtgagggtgcgtctccctgacaggtgtccccgctgggatttcgagcaatgctgagaagccgaaggccctggtcttggagaccaggacagggccctgggaggcccaggtcgaaagggggccagtcagctcatggggcgagggaatgtcctgctcacaccctccactggggtctcaggaattatccgatgaaaagtagaagaggttgaatgactttcagtggccttttcttcacagattttccatatgctgttccatctgccaagaatgctctcaaagtggccacctcctttgcgtgtgaaatgtcctagcttaaatgtcagctgctcagaaagactatcctggatcactttaattaggtccatgccagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282970 - DNA, 1530 bp, Homo sapiens
ctcgcgtcacagtgacagccaccgttgcctggggacgggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggaattatccgatgaaaagtagaagaggttgaatgactttcagtggccttttcttcacaggcacaaggagagaataaagaaaaaggagagcttataggaaagaagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtggctatagcaaggtactggatgccagtccaggcacacagagacatcactctgaactggtacattccgggaaatcccaagattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282971 - DNA, 1577 bp, Homo sapiens
agcgggtgtggcagtgcgtcccctctccgcgggatcgtcgccatggtcctgcgatcctaggagtcgggcaaggccgaacctgcctgaagaaacctcaagcggagattcaaggaagcaccacgtgatccctaaggatcccaaagatgcgtcgggcatgcatgggcggtgtgagggtgcgtctccctgacaggtgtccccgctgggatttcgaggaattatccgatgaaaagtagaagaggttgaatgactttcagtggccttttcttcacagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtggctatagcaaggtactggatgccagtccaggcacacagagacatcactctgaactggtacattccgggaaatcccaaggtgaacttgactatgatcatcctctctcattggttcctgggcaagagggttgtagaaggcagaataaaggccccccaaacatgtccacaacctaatccctgaaacagtaacagtactgactcaatgataaagaaaagcttgcttgcttaaatataattactttgcttgactttgtagattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282972 - DNA, 1322 bp, Homo sapiens
agcgggtgtggcagtgcgtcccctctccgcgggatcgtcgccatggtcctgcgatcctaggagtcgggcaaggccgaacctgcctgaagaaacctcaagcggagattcaaggaagcaccacgtgatccctaaggatcccaaagatgcgtcgggcatgcatgggcggtgtgagggtgcgtctccctgacaggtgtccccgctgggatttcgaggaattatccgatgaaaagtagaagaggttgaatgactttcagtggccttttcttcacagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282973 - DNA, 1348 bp, Homo sapiens
ctcgcgtcacagtgacagccaccgttgcctggggacgggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcccctagaacctccagaaggaacatggctctgctaatactatgatattagccctttcagactgatttcagacttctgaccagcagaggtataaatcataattatatcgatttaagccactaaattagtggttattagtaacggcagcaacaggaaactatatcagcaacaagactccttccttcatagaacccaattcccaaccaattttcaaactttcacagaaaatcttgccacaca

SEQ ID NO: 282974 - DNA, 751 bp, Homo sapiens
agcgggtgtggcagtgcgtcccctctccgcgggatcgtcgccatggtcctgcgatcctaggagtcgggcaaggccgaacctgcctgaagaaacctcaagcggagattcaaggaagcaccacgtgatccctaaggatcccaaagatgcgtcgggcatgcatgggcggtgtgagggtgcgtctccctgacaggtgtccccgctgggatttcgaggaattatccgatgaaaagtagaagaggttgaatgactttcagtggccttttcttcacagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgccttctttccacaggcctttgaagagagcttcaggcacacacctcaaagtgctgccacctacggatcagctgtattattagcaatagctgacactgtgaccagcctttattcacctgagctctgtctttatgtcatggttctcatcagcatccagggctcctttccttgctccagtaaggaaagtatatttggcttagggactgcacatacagcttaaaagaaaggaaatggtgcatggtcatgctaggggattcccagattcaaatctagtccattggcatcaaagaagggagacactgacaggaagtgacagagaaagatgtgacagtcta

SEQ ID NO: 282975 - DNA, 1001 bp, Homo sapiens
agcgggtgtggcagtgcgtcccctctccgcgggatcgtcgccatggtcctgcgatcctaggagtcgggcaaggccgaacctgcctgaagaaacctcaagcggagattcaaggaagcaccacgtgatccctaaggatcccaaagatgcgtcgggcatgcatgggcggtgtgagggtgcgtctccctgacaggtgtccccgctgggatttcgagcaatgctgagaagccgaaggccctggtcttggagaccaggacagggccctgggaggcccaggtcgaaagggggccagtcagctcatggggcgagggaatgtcctgctcacaccctccactggggtctcaggaattatccgatgaaaagtagaagaggttgaatgactttcagtggccttttcttcacagattttccatatgctgttccatctgccaagaatgctctcaaagtggccacctcctttgcgtgtgaaatgtcctagcttaaatgtcagctgctcagaaagactatcctggatcactttaattaggtccatgccagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgcgccaacaggatttctttagtactaagcttcaagaaaccagcaacttgcttgagatgtgtcccacttctcgttctgggcccatgaaacttggatgaaactatgcctgccatctggttcttacttcagggtcacggacttaagattgcccattcattcctctttaataagacatcttggtggactaatggctaaccagtccatgatcacacatcactgtgatggtgtcacacacttggtattttttaatttagggaatgttgtgatccaacatggctgtcacggacttgatgcaataaagcaaactgtagctgagctgaaa

SEQ ID NO: 282976 - DNA, 464 bp, Homo sapiens
agcgggtgtggcagtgcgtcccctctccgcgggatcgtcgccatggtcctgcgatcctaggagtcgggcaaggccgaacctgcctgaagaaacctcaagcggagattcaaggaagcaccacgtgatccctaaggatcccaaagatgcgtcgggcatgcatgggcggtgtgagggtgcgtctccctgacaggtgtccccgctgggatttcgaggtacggcctgcctgtgtttccccggggcgctctctttccggaggggtttcctggcagagagcagaaccgcgcagcctcaggagctgcctggctgtgtgtgtttctgtgcgactgttggatgtttccgtgtgtctttctgtgtgtgcgtgtgagtgtgtgtgtggtgtgcggtgaaagaaatgtggctcgtgcagtgaagcgcggtttctctgtagttcgcctacgctctgatgcgcccgtctctttggccgg

SEQ ID NO: 282977 - DNA, 749 bp, Homo sapiens
agatcctaggaaaggaaactgggagcccgggagaactaaaattcccaattaaaagtgaatttaaatctgagctgttcttagacccagaatttcttgcctgaaggaggaatcaggtccccacaaggaaagaccctgcaactgtataaaaaaagaatctaaaaagatcatgactccttcagtcctttcccaaagagacctatggaaatttcctcaggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggacaactttaccaggccaacccagcctcaaggctctccacaggaacagggaccctgaaagctgtgtctatgaagttattacaagatattggctactgtggtgcatggagcttctaggccagggtgattctcacacctgcctgatgtggatcttgttgcttcacacctgaaacatcatttgagaagcccgggaagtggtg

SEQ ID NO: 282978 - DNA, 1004 bp, Homo sapiens
caggtgtgagccactgcgtctggcccagtttgacttttggatactgtgttttagtttttttttcttgatacagggtctcactttgtcacccaggttggagtgcagtggcacaaacacagcttgctactgcctccacctcttgggctcaattgatcctcctgcctcagtcccataaatagctggccctacaggtgtacgctgcattctccggctgaatttttaaattttgtagagatggggtttcacaatgttgtctaggctggtctcaaactcctgagctcaagggatctacccaccttggcctcccaaagtactgggattacatgcctgagccactgctcctggtctatatacagtgtttccactttagaacattttgtaacaaagcagcaatacattgttttaagcctgagcaattactttataataaaaccagttattttaaagaaagttacaaagtaaaagcagctttagtagcctgcaaataaagccaaggcaggaaatgggtcctctctacagtggggctagtcctgggcaggaccttgagctccggtttggccagccttcaggacgcccagcccgttctagcagggaaggagtgataaggaattaagaggccagaccctgggttggccccttggccccagagccaaggtctgctgaaaaagccagggaccctgaagaaaggcagaattaggagccagaccctgcctctccccaccgctactttgactccaaccttcatcaaaaaatgatccccaaggccactgtgcttgggtctctggttttttggaccccgagtctgggtagaagttctccaacccacttatggctgaggaagggagacttacgtttcccttgcagggcacttgcctcctgcccatcccaccctctcaccttgattgaatttggaaggatgcccagctccccactccacccccaaaaccagcagaaccctcaaacagagtcacaggaccgctcccctgaggtttagcatcagtctt

SEQ ID NO: 282979 - DNA, 3474 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 282980 - DNA, 277 bp, Homo sapiens
ggctgaaattgaagctttttattttggatatacataccactattactgttttaaagacatttttatgtagtgatactttgtattatggactctataaagttctatactgtaatcaagacatttatataaagtgacactttgggattatttggcctcataagctagatgccagtgaaattggcatacacatcaatagacatgtttacacttccagtgttagggtttttgtttattccagttgtacttcctttggcagacggctattatgttttacttt

SEQ ID NO: 282981 - DNA, 3413 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggagtaagtcttgaaaattgaatcttagtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 282982 - DNA, 3420 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaagtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 282983 - DNA, 2912 bp, Homo sapiens
  misc_feature (1609)..(1609): n is a, c, g, or t
  misc_feature (1622)..(1622): n is a, c, g, or t
  misc_feature (1736)..(1736): n is a, c, g, or t
  misc_feature (1827)..(1827): n is a, c, g, or t
  misc_feature (1908)..(1908): n is a, c, g, or t
  misc_feature (1957)..(1958): n is a, c, g, or t
  misc_feature (1966)..(1966): n is a, c, g, or t
  misc_feature (1968)..(1968): n is a, c, g, or t
  misc_feature (1970)..(1970): n is a, c, g, or t
  misc_feature (1972)..(1974): n is a, c, g, or t
  misc_feature (1976)..(1986): n is a, c, g, or t
  misc_feature (1988)..(1989): n is a, c, g, or t
  misc_feature (1992)..(1994): n is a, c, g, or t
  misc_feature (1998)..(1998): n is a, c, g, or t
  misc_feature (2002)..(2004): n is a, c, g, or t
  misc_feature (2009)..(2009): n is a, c, g, or t
  misc_feature (2314)..(2314): n is a, c, g, or t
  misc_feature (2722)..(2722): n is a, c, g, or t
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggagtttttgtctaggtcctttttccgtctcactagacagaaggaccacagaaggcccatccagaggaccacgttatatttgattgtcatgtctccttatgatctcctaggctgtaatagtttcttagactttccttgtttctcacgagattgatatttttgagaagtattggtcagctcttttgtagagtgtccctcaatttgggtttattatttgatgcttttcacatgattagattggagtcatgtgtttttaggaggactgccatcgaggtgaagtgttattcttgtcacatcatatccaaggtacagacttgcagcatgatttatcattgtttttgttttttttgtttttatttttatttttttgagatgagatttcgctcttgttgcccaggctggagtgcaatggcncaatctcggctcnctgcagcctccacctcccaggttcaagcgagtctcctgcctcagcctcccaagtagctgggattacaggcatgcgccaccacgcccagctaattttgtatttttagtagagacntagtttctccctgttggtcaggccggtctcgaactcctgacctcaggtgatccgagtgtcttggcctcccaaagtgctgggattacaggcntgagccaccgcacccggctgatttatcattgttaatgctaacctcaatcaccacacctggctgagatagtgtttgacaggnttctctgctgtaaagttactgtactctttttattccccttttatagtgnnctttttanangnannncnnnnnnnnnnncnnacnnnaggngggnnnaattntgttccacccccttgaagggggcactatctacataagttatttggaattcttctgaaagggagatttgtctttcttccctgcttatttatctatttggacaatcacttatttaatatcagcgtggactcacgtatatgtattttgaactttgagttataactatgactttgagtatgtcatttgttgttcagattggctgggtttggcgattgggaactctcagttggctcctgtgttcctttaacatcttccaatgttttgcctttttgaatacttccttacttgctggcactacaagacgccncaggcttatcttgtatattccatgccctaaccctagaatcagccgttctccaaggagcactggttcctttttaagtaaaatggtattagaaaccaagatttggggactggatgggctttttgttgaaatgctgttgcttctgtacataatattttaagtggggaaaaatggtagataagttggaagtgttaagagtggttatttctgggatgggattatattttgggggctttttcttactttaaaaatattttacagtatatttattacctccaaaatgaggggaaaatttttttaattaaaaagtggaaataacattacagtaaaagtttttacacataaagcttttaaaaatacatatataagaatattttcttaggattcccagaatagtgattattgagttanaggcatagaatgttttcatagttaatggtttatattgccagattgcgttcatactctccaaattaatgtattggattatttcaatgaatatcatcattgagtattgtttaaaaatcattactgatttaacaaatgaagaattctattgtaatcttttatcttgatgaaataaattttgatttttaaaagc

SEQ ID NO: 282984 - DNA, 3141 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 282985 - DNA, 2449 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtaagtagtcttggtcattggcagtcctgcttttattaaccatagaaggaaatccaggttagcttttgtttttgcaaatggacacatttccttgctgaatttgtggctttatacatgtggcattttctgtaatttgctattaaagcaactcttaagtgcagaagttaaaaataagatttattttatcttgaccttttgtgaatgtgtcattttcttagatgtatattatctctctttcttgaataagcacagatggacaaatt

SEQ ID NO: 282986 - DNA, 679 bp, Homo sapiens
ataatattcaacaatggtgacgttttagtggttagattaattggaggtaaatataaattaatcaatgtaacttagaattcatttatataaaatctgtaaaagcagtttgtattaagtatcacatacctaatccttataagatactaaaatgatttaagatttgtttatctattatatttaagtgaatgctactaagatatataagatgcttaggaggttttctttcggtttatttttttaaatttaaataatattttccccactctttttagaggctggaaagagagtatggctgtccttgtatcacaggaaagccaaaagttgcctttcgagagaccattactgcccctgtcccgtaagtatgcaacgtaattaaacattatgaggctgaaattgaagctttttattttggatatacataccactattactgttttaaagacatttttatgtagtgatactttgtattatggactctataaagttctatactgtaatcaagacatttatataaagtgacactttgggattatttggcctcataagctagatgccagtgaaattggcatacacatcaatagacatgtttacacttccagtgttagggtttttgtttattccagttgtacttcctttggcagacggctattatgttttactttagtgccgtattgtggat

SEQ ID NO: 282987 - DNA, 2154 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggtaaatttttaaaaaagtgtttttgcatttttacttactaaaaacagtttatcaggtattaaatcatactttgtcttccatcatgttgtctatcacagtttgttttagttacagtcctgtttctctgattgttaagctttccatctgatttagaatctctaattcattaagcagaagagctgtaaatccatgctgtgacaatgatgggaaattattatgtttctgaatcatagttatatttttcttaataaattgaaactactgtattgattgt

SEQ ID NO: 282988 - DNA, 3037 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagcca

SEQ ID NO: 282989 - DNA, 2634 bp, Homo sapiens
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactga

SEQ ID NO: 282990 - DNA, 2668 bp, Homo sapiens
  misc_feature (959)..(959): n is a, c, g, or t
  misc_feature (2076)..(2076): n is a, c, g, or t
agcggagtgctcttacaacattggctgccggcgtgactttgaccgcttcccggtgcgttaccggcagctgaacccacccggcgccacgggactttgacgcgtgctctgcgcttgccatgagactcctgggagccgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattatagatcttattgaggaacgagccatctattttgatggagactttgggtaagtgctaaaaatacattattaaaattttaaattttaaaaagcattaaaaagaaggaaaggataagttcatcaaacgcagagtaactatctttttgaaatgcgactgcaagaatactctgagatggttttgttttaatacctttaatcctantcgctccccattttatttagtatttattctgtgagagactatgttactttttgggtaatatacccatatcacattatggcatgcatggtgtggtagaaggaggccttcagtttgggttagtaaatttgggttagtgaatgtattgtatctttttgcacttgttcatttattcattcattctgtggacttttatagagcagctgccaggtctggggtattgtgataaaaattaggaagaaaatagagatcataaatatttgctcttcctgctttataattacatggacagaaaagattaataaattaaaacagttaaaattgtacaaatgtggtttgggaaatgcaagaaataagttggtaactttttgatgtggtatttggtccatcagctcttgagtgacctttacctacaaagtactgtaattgcctggtagttatcaaaccttagcgttgttcataacaatcccctggagactttgttaaaagacatagtcctggctctacctccagagattctgatcagtagattggggtggggcccgtagtttgcatttctggaaggtttccagttgatgctgctcttacaggtctgcagaccacactttgagtgacactgatctagacaatgtgaggagtcataaatgatcctttgttctgaggagtgacctctgtagcctggtcgtttctccacaggcacttcctgagggatttccttcctctgctatggaattgggatcgcaggtctggcaggtgggcgaatggcattgtgatcagtgaactatagaatttatcttcatcagccatcttgtaagcaggaaaaggatggagtctgtccagtggataaggtgtttctctcactttttatgtaacaactgagtaatgacaacaaagtttacctaccactccttaggatataaggcccagtaaggcagagtttttgtttttcttttttcctactttattcactgctatgtcccagcccctagaacaactagttacaactaggcagttgtaactgcctagtacataatagggactcaaaaatatttgtaaatgaatgaataaatccactttcccagaattaccaaggcacatatttctgttgtcagaagtaganactcttaaactttgttgtacatcagaaccacagatgcagcatcttaatgtacatgtccccttccccagccctagtttactgtatgtgtatttggaaaggaatccacagatgattctgacatgtgaaaggctaagaagcagggagcttgccaggaaggttgaaattaaaatctgaaagttgtggggagtcttagaatattaagtgttactttttgttggaaatggcttcttttgtctttattaaagttaggaatgtgttttctgaaaagcttactttttgatattaatttccatttttaaagaaataccttgaggccaggcgcagtggctcacgcctgtaatcccagcactttggaaggccgaggtgggcagatcacgaggtcaggagatagagaccatcctggctaacacggtgaaacccgtctccattaaaaatacaaaaaattagccgggcgtggtggcgggtgcctgtagttccagctactcgggaggctgaggcaggagaatctcttgaacctgggaggcagagcttgcagtgagccgagatggcaccactgcactccagcctgggtgacagagcgagagtccgtctc

SEQ ID NO: 282991 - DNA, 559 bp, Homo sapiens
gcggccgcccaagcccggctcccacgtcccgctctcggctccccggaggtcggagactttgaggtatctccacgtcaaaccttcatgaggcgacaccgcaagtagctgctgaggacgtagcggatcctctccatctccatttggtggatgctgaccttcaggtcctcccttttggctctcctgagattttcttcctattaaatgagaaattaaggtttataaaaaacatgatgttcaaccatcatcaccggcaacgttgaggacccagactatgtttcagtccaaggaaaacaaaaatatcatgttttatgcttgaaatggctacatctggtttctggtcacacagtggcatgataatggctcactgcattcttgacctccaaggcttaagtgatcctcctgcctcagcctccagagtagctgggactaaaggtacataccacaaagcctggctaatttttaaattttttttaataaagatggggttttaccatgttgcctacagtggtcttcgaaatcctggcctcatgacatccccctgcattagcctccagaagtg

SEQ ID NO: 282992 - DNA, 250 bp, Homo sapiens
ttaaagacaggtagggcagatcaacttcttaaagacctgtccgctagctttctgttccctcaggcaacatgtagtctggggtagcagatgcagaatatcagcaaagaagattcactggcccagcttcaaaagctaaacagaagatgacttcatactttgttctgctaccttcttggattacttctgtggaagcctcgaaaaattataaaaaatgccactccatgatcttgttgaagacatttctgagttt

SEQ ID NO: 282993 - DNA, 344 bp, Homo sapiens
ggtaagaggactttttgtgtccagacagatggcaatactcatccgtatgttgtctgccccagggcaagtgtcacagtgagtacgaataaagcgatcaataatttgtctatctgaaaagtatgaagaaaaacaggatgaaaattttcactttgatgaagtgacacatgcattactgtaacccacgaccacaggatgatatagatcattccttccatcccagaagacccttcatgcaccttcccagtcaacactccctacttcaagacagccactgttctggtttctttcatcaaagataagttttcccagttgtagaccttcaaataaatgaaatcatacagaag

SEQ ID NO: 282994 - DNA, 2199 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 282995 - DNA, 2551 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 282996 - DNA, 3010 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcttacccacttagatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtgagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 282997 - DNA, 2379 bp, Homo sapiens
  misc_feature (20)..(20): n is a, c, g, or t
gaccatagaggatcccgccntgtaccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 282998 - DNA, 3162 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcttacccacttagatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtgacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttgagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 282999 - DNA, 2951 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatgtgactgcttcctgcatctgctgcatctccgtgggctcccctcagaccctcttctgaaggcctggggtgtctctcctgccaccatgcctgtgtctgcaggtgcctgccaccagccccagtctgctgcacgggccctggcgagtagaaagcacttgccttctgaccacacggggagctgagggtcagagacggaaccagggctcgaccctccaccttgaaaccttgagatggggatgctcctcattctagccagctcctcctcagctctcaaaacaaggaacagatgctcaggaaaccagacctggacaaaaggcatctgagcctggtgtgaggcagattccagaagtttagttacagacatcctttataaggagtcttcatcgggaattcaagacaacctggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 283000 - DNA, 2369 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttgagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaaggtgtggttgactgcagagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 283001 - DNA, 2149 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 283002 - DNA, 1286 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttaaaaaaaaaaaagtcgacgcggccgcgaatttagtagtagta

SEQ ID NO: 283003 - DNA, 983 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaaggtgtggttgactgcagagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctagggtaaaggctgaattacataaacattgaaaaaatgtatgtgct

SEQ ID NO: 283004 - DNA, 445 bp, Homo sapiens
gttggaccaagggaagtatgatgctgatgacaacgtgaagatcatctgcctgggagacagcgcagtgggcaaatccaagtatgttgggagattagggaataaataccagccccagagagggtccaggtcatttaaaaagtcctccagaggcagaggagcatggcttcttggggctggtgaaggagcagtcttggctggagcccagatgttcatgggggaacgaggggaatcacgtgagccgttgtgtgtgtcaggtggagggggcaggtcataaggactgaggaatttgaatgtttcctctgagccctgagagaacgtgtggagcaactgaggacattgtatgtggtttgtgggctgagggatggcaagggcggggagtgggaatggaaagacaaaagtgactatgccaccgtgacagattgggtaaaggtggtaaagatgcttt

SEQ ID NO: 283005 - DNA, 864 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcttacccacttagatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtgacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaac

SEQ ID NO: 283006 - DNA, 2796 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtgagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 283007 - DNA, 2810 bp, Homo sapiens
cccagtaaggctcacctattgctgctgtctcatcatcatatcatttctatgtgcccccctagctaagagtctggactgtggttacattctcaggaatgtttgcaaagtcatatttaggtgtgaggagagtaaaacagagctagacataatgttgcacacagcctttggcactggatgcctggtgaatgtcttgtgcaaatgggtaacgtgaggagcagcatttggggtgcgcaggacttaactatttgtgtataacatattattgatgcctgtgtgtcatactctgctactccaagtctagtagtcaattgcataccatatctcagtctggcactgagggaagcagtctggagggaggtacagctggagatttggttgaggggacttatctctgacaacagcctcttgttgatcttcccagaagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 283008 - DNA, 2569 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaaggtgtggttgactgcagagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattgaaaaaatgtatgtgct

SEQ ID NO: 283009 - DNA, 2187 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttggactctgggcactgttggactctgggcactgtttggactctgggcactgtttggactctgagcactgtttggactctg

SEQ ID NO: 283010 - DNA, 1596 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtatagaaaaacataaataaggttgggcatggaggctcacacctgtaaccccagcactttgggaggccgagttgggtggttcacccgaggtcaggagttcgagaccagcctggccaacatggtgaaaccccatctctactaaa

SEQ ID NO: 283011 - DNA, 1280 bp, Homo sapiens
agcagctgcgaggacgcgggccgagccggaagtggagtgtgctgcggcgcgagctgggccggcgggcgtggttcgagagcgcgcagagtccagactggcggcagggcccgaggggccgacccgcagcgtccctggtctctccagccctcactcggaaccgcacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgccaagaagttctccctgcccctgtatttcgtctcggctgctgatggtaccaatgttgtgaaggtgtggttgactgcagaggtagctagcaaggtcagggcgctaggtggtaaagggaagctgtgaagagaagggcttactgcaggtgtgatggagagaaccgggacagtgcatgggcatgggtggcagggaggggaggagctgatgggcctggacttgatgaggcagaagtccattgaccatacataggtaagagggctaggagg

SEQ ID NO: 283012 - DNA, 475 bp, Homo sapiens
cttgtggggaggcttaggacgggcgggtgcaatcctcgaaggggagtctcagcgaccatgggggacaccatccactagatgtcaggctgaaggagatgatgaaactctgtaagccgaagaacatggggaaagaggagacacaggaagccacgctatccccacagggacccctgccagccaggccacccgcaacggtgtgggacgtgagtgccgttgcccccggcggtccagcagcaggagccccgagcagcctggcctaggaggctcaccgcagccgtcaagggattctgggccacccgcccttccttctccaccttctacttcgtctttgccatttttgtggtgtccaccatctttcactgccaccagcacctggctctggtgcctgcgccctgggcatactcagcccgtgtggtcctggcccccagacacctgccccgggaggacctgttcactatcaactccaagggccgcc

SEQ ID NO: 283013 - DNA, 737 bp, Homo sapiens
agcggggggttcccgcccgcgcctctccctccacacctccccgcaagcagagggagccggctccggccttggccagcccagagacaggctcccacagtgcagcggcgggctgaagggctcctcaagcactgccagagtggacaccgaggccgaggagacgccaagagcgatgaaacaagcttctggttcaagagtttcttcaggttccactacgggctgttcttctacaggtgcgccgatgtccacagtgctaccttctgatgagctactgctttcattcagtttctgctgatttaatatgtgagctgacagaatgcagagaccacgttgtatatgaagcatccactttgccttgtacaccagggcattcaataaccacttaataactacaaccctgatgatccgattcactactaaagtcttccgtgtttaaattttcaaagtcagattctcctacagcaattggtacagtcacagtaagactggggttgtttatgaatgacatgtaatcactttcatcaataatgtatttttcaacactgctgccagttcctataccacttgtagttccatttacatctttaagatagtcaagatctttcccaatttctgctgtatgattggacatacaactgtctttcttgttgtttagatcatcaagtggtttaatttcatctaaaatcttttgtttcctaatgaaggactgttgaataaattcatatatttttcttttcaca

SEQ ID NO: 283014 - DNA, 479 bp, Homo sapiens
gcagagtctcctgcacaccatctccccttccagcctcggtgtctgggctggggaagagcacacagatgggtgctgctcctttaggcacactggcagaggctttcttttagcacttgtcccacagttcctcaatggaagtagtatttcccattcccaagctctgctcaccacactgaggagaggcagatcttaggagttcctttgccccaaggccgcctcttcctcacctaaaaccggatccttgcaagatcaccctgaggattctctgagaaccctgtcgcccgcaggcccattctaagcactagggatagagccatcagggagatggaccagagccacggacttcagtgcccaactcacagtgggcactaggccataggttatgacagtgccaaggaaggtacacctcccagatgccaggcagggtggctgctcccttctcaccctacttccctctccacagggcccacggacctcag

SEQ ID NO: 283015 - DNA, 642 bp, Homo sapiens
atccgttcctgcgggatcggttcccatcatccaatacctcccaccagactccacttccatcattggaggtcacatttcaactaagatttggaggggaccgtatcctaactatattaacttccaattttcatcgaaagcccacctgtctaagaagagctcctagacattccctttccccttcaacttggaggaattgggaatgacaaagagaaattaatcaaaagaagaattaatctctccaatcagccttggcattttctttctatctttgatatgttgttttttacagtgtcttggttttcagaataagctgtttgtaactacttcctccactatattgtgagcctctggagggcaaggtctgggccttactcatctttgagtaattttaaagccactaaatagggctctgcacatagtgagaattcaacatatgcttagttgaatctaatatttcagaaaaagtcaacatctattctttaagatagcccacagcaggctgagtgtgttattcgtaaatccattggccagcgtcatttcctccaaagtgcagcatttttgatagaaccaaaggctcatgactgaccttcagaaagacattttgtatttcaccatcaaagagtggtatgggttttattagac

SEQ ID NO: 283016 - DNA, 521 bp, Homo sapiens
tttggtcctttaagaaagtcagatttaatgatctgaaatgtctcatttttaggtgatatttggttagcaacgtcctactgtagacattttgatgtggtggtgattggaatatggtctgcagagatcaaccagaattagctccatgtgccactgggagtgggaactgaagtcacgcaggaataaaccagtcttcatgctttaggatgttctgatgtgccattgtcgtgaaatcttcattcatgagacattccagtttaccggcagtgtcgactagaatatgctacagcccccaaaatacgtttttagtataaggattattttgagctgattattttgagaaatagcagacgcaggagaaactctgaagacagaacgtaagtttaccttttgtaaagggatttacatttataagggaaatgtccatttgtaaggctgtctccctctgtaccggaaacacgggatgactataagtgacaaagagattaatttaaatctgcatgacaaatcttactcaagcttac

SEQ ID NO: 283017 - DNA, 523 bp, Homo sapiens
tttggtcctttaagaaagtcagatttaatgatctgaaatgtctcatttttaggtgatatttggttagcaacgtcctactgtagacattttgatgtggtggtgattggaatatggtctgcagagatcaaccagaattagctccatgtgccactgggagtgggaactgaagtcacgcaggaataaaccagtcttcatgctttaggatgttctgatgtgccattgtcgtgaaatcttcattcatgagacattccagtttaccggcagtgtcgactagaatatgctacagcccccaaaatacgtttttagtataaggattattttgagctgattattttgagaaatagcagacgcaggagaaactctgaagacagaacgcaaacttcagctagtgtcttgaatttaagtcccaaatcatctaagaagcggtcatctagctctccttcaataaaactgcaacaaccaatagaagcattcagcgattcagtttcttcctgagaataaaccagaaggcaatctttggctg

SEQ ID NO: 283018 - DNA, 1392 bp, Homo sapiens
atccgttcctgcgggatcggttcccatcatccaatacctcccaccagactccacttccatcattggaggtcacatttcaactaagatttggaggggaccgtatcctaactatattaacttccaattttcatcgaaagcccacctgtctaagaagagctcctagacattccctttccccttcaacttggaggaattgggaatgacaaagagaaattaatcaaaagaagaattaatctctccaatcagccttggcattttctttctatctttgatatgttgttttttacagtgtcttggttttcagaataagctgtttgtaactacttcctccactatattgtgagcctctggagggcaagctttgatagattgactttgcctcttttactgcgtgcatagtgccatcttgtggccataaagcatataacactcatagttatgccacagtgcttctgttccatcttatttctgtagtccagaggatctcttaagtgtagaaacacatggattattactagccaaggccatcactggccaagcccatctaaaagccagaggcagcaagcagtgcccgttgaaacatccataaaaggtgatatttggttagcaacgtcctactgtagacattttgatgtggtggtgattggaatatggtctgcagagatcaaccagaattagctccatgtgccactgggagtgggaactgaagtcacgcaggaataaaccagtcttcatgctttaggatgttctgatgtgccattgtcgtgaaatcttcattcatgagacattccagtttaccggcagtgtcgactagaatatgctacagcccccaaaatacgtttttagtataaggattattttgagctgattattttgagaaatagcagacgcaggagaaactctgaagacagaacgttatatatcctctgcctctcctacggagctcatccctaccaagcctgctcctgcagagggatgcaactttccgacccactgacatctgtcttggtcatatgacttgctttggtcaatgaaatgtggtgtaaaaaggtggaggctttgagagccattgcctggttctgccttgttcttttctttgggtcacaaggacggcagcttcccaggtacaatctgctctctcagtgtgcatcttgatatgaagacatcatgaaggaaagcagagctgactgactggcaaaaacataactgtggatagaacccaaagagaaaacaaagcccaaacagtctcagctcctttactctatgcgaccaatggcatttcaacctccctctacagtttgataccttcttctatagttacagaattcttaactttgttttgacctggatccatggccacccaaaataaagactatatttctaagcctctga

SEQ ID NO: 283019 - DNA, 1063 bp, Homo sapiens
atccgttcctgcgggatcggttcccatcatccaatacctcccaccagactccacttccatcattggaggtcacatttcaactaagatttggaggggaccgtatcctaactatattaacttccaattttcatcgaaagcccacctgtctaagaagagctcctagacattccctttccccttcaacttggaggaattgggaatgacaaagagaaattaatcaaaagaagaattaatctctccaatcagccttggcattttctttctatctttgatatgttgttttttacagtgtcttggttttcagaataagctgtttgtaactacttcctccactatattgtgagcctctggagggcaagctttgatagattgactttgcctcttttactgcgtgcatagtgccatcttgtggccataaagcatataacactcatagttatgccacagtgcttctgttccatcttatttctgtagtccagaggatctcttaagtgtagaaacacatggattattactagccaaggccatcactggccaagcccatctaaaagccagaggcagcaagcagtgcccgttgaaacatccataaaaggtgatatttggttagcaacgtcctactgtagacattttgatgtggtggtgattggaatatggtctgcagagatcaaccagaattagctccatgtgccactgggagtgggaactgaagtcacgcaggaataaaccagtcttcatgctttaggatgttctgatgtgccattgtcgtgaaatcttcattcatgagacattccagtttaccggcagtgtcgactagaatatgctacagcccccaaaatacgtttttagtataaggattattttgagctgattattttgagaaatagcagacgcaggagaaactctgaagacagaacgcaaacttcagctagtgtcttgaatttaagtcccaaatcatctaagaagcggtcatctagctctccttcaataaaactgcaacaaccaatagaagcattcagcgattcagtttcttcctgagaataaaccagaaggcaatctttggctg

SEQ ID NO: 283020 - DNA, 685 bp, Homo sapiens
aacggacgtgcagggggactgtgtccgtagacgtgatggcctgagcccagtcctgctgctagagggaaggaaaaaggcgaagtaggagggagagagagagacagagccgagcccacgccgtggagagctgtttggttgttattgttgtagtgtgtgtctgtgtgttttctttctggaacctctgagctctgcctatggtttccaactttcggcttctaatccccaccccacccaggaacgagcaacagaaaaacaacacttgtctgcctgagaaggctccggaaaaaaaaaaaaaaaaaaggaagaaaagcgacctcaaagagatgagctctcggctcagttgtcagcaaacaacaacactcccccgctcctccgctgggccatcctcccagccccagcccgccggagaggacagaccgacgcaccgacaggcccctctccccctcgcccgtctttgttacatctttagcagctttgtgcgtagctggcggcctcgagcagaatctgcacgttctgcagaaaagtgttgatgtgcttctccatcgagttctcgctggtgttgaaaatgtctgagaaggggcacctgggcttggccccagcggggtcctcgggcagggccgggggctggggcgcggccacggcggggggcacagccgggggcgcggcgggggccagccccgcgccc

SEQ ID NO: 283021 - DNA, 2142 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggtgagagccccgggtccgagccccctcctccttcaccgggttcacaggggagatgatgtagaagggccgagaggactgtgagccctaatcccgcactcttgcaccaacaccagcagccacctcccgttcccagggcttcaggtaccccctcgggagtgttttcacccgcatccatttcattcaggcagcagcactgcagccccttccaggttgagtataagctccgagggggtgccctcagcctggaggggaatgccatcttcccacgatggcctctcaggcccgcgctgtgatccctgttctctcccagggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283022 - DNA, 2111 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggtgagagccccgggtccgagccccctcctccttcaccgggttcacaggggagatgatgtagaagggccgagaggactgtgagccctaatcccgcactcttgcaccaacaccagcagccacctcccgttcccagggcttcaggtaccccctcgggagtgttttcacccgcatccatttcattcaggcagcagcactgcagccccttccaggttgagtataagctccgagggggtgccctcagcctggaggggaatgccatcttcccacgatggcctctcaggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283023 - DNA, 2335 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggcccccacttccagcatccctaaagaaattcaactgtgttgggtactagaggagtaaagaaggcagacctggtacaaagttttcagaacatgggacagcggtcctgtgaggactgggagcccagtccaaccaggcactccagcctgggtgacagagtgagactccgtctcaaaaataaataaataaataaataaataaataaataaataaataaataatagcccctgcttcctgagcacttcctaagtgcttaacatgcatctactcagctaaaccagtaacgctgtgaagtcaaaagccattattattcccatttgatgcataaggaaccaaggctcagataaggcacttttaggagatctgaatcctgtttaccttgttctaaagcctgtgtgttaatcactggacagaacttccctcactgccttaagtgaaaagcattctataacctgagacagtctgtgcaaaagtgtttgtaagtgtaacttaattccggtttcccaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283024 - DNA, 2221 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggcccccacttccagcatccctaaagaaattcaactgtgttgggtactagaggagtaaagaaggcagacctggtacaaagttttcagaacatgggacagcggtcctgtgaggactgggagcccagtccaaccaggcactccagcctgggtgacagagtgagactccgtctcaaaaataaataaataaataaataaataaataaataaataaataaataatagcccctgcttcctgagcacttcctaagtgcttaacatgcatctactcagctaaaccagtaacgctgtgaagtcaaaagccattattattcccatttgatgcataaggaaccaaggctcagataaggcacttttaggagatctgaatcctgtttaccttgttctaaagcctgtgtgttaatcactggacagaacttccctcactgccttaagtgaaaagcattctataacctgagacagtctgtgcaaaagtgtttgtaagtgtaacttaattccggtttcccaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283025 - DNA, 1143 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283026 - DNA, 1788 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccaggatcctgagaagggggaaagactgggaggagctcggagaggagatgtcccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283027 - DNA, 1831 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283028 - DNA, 1972 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggtgagagccccgggtccgagccccctcctccttcaccgggttcacaggggagatgatgtagaagggccgagaggactgtgagccctaatcccgcactcttgcaccaacaccagcagccacctcccgttcccagggcttcaggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283029 - DNA, 2040 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggtgagagccccgggtccgagccccctcctccttcaccgggttcacaggggagatgatgtagaagggccgagaggactgtgagccctaatcccgcactcttgcaccaacaccagcagccacctcccgttcccagggcttcaggtaccccctcgggagtgttttcacccgcatccatttcattcaggcagcagcactgcagccccttccaggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283030 - DNA, 1926 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggtgagagccccgggtccgagccccctcctccttcaccgggttcacaggggagatgatgtagaagggccgagaggactgtgagccctaatcccgcactcttgcaccaacaccagcagccacctcccgttcccagggcttcaggtaccccctcgggagtgttttcacccgcatccatttcattcaggcagcagcactgcagccccttccaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaa

SEQ ID NO: 283031 - DNA, 1756 bp, Homo sapiens
ctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaaggatccctcaagtttccaacttgtaaaaagaaaagtgcctgtaaagattcgaatagattagacttgccacccatctccccagtcttttgtttaacaaaaaa

SEQ ID NO: 283032 - DNA, 4344 bp, Homo sapiens
gagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagtttgaaattggcacaatggaagaagctggaatttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttggtgagcccagcatactgcacgcaagaatcaagagaggaaatccctgggggagaagctcgaacagatccccctgatggtcagcaagattcagagtgcaacaggaacaaagaaaaaactttaggaaaagaagttttattactgatgcaagccctaaacaccctttcaaccccagaggagaagctggcagctctctgtaagaaatatgctgatcttctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcaaacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctatcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacatgcctagaatcctaagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaacttaaaaaaaa

SEQ ID NO: 283033 - DNA, 4397 bp, Homo sapiens
gagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagtttgaaattggcacaatggaagaagctggaatttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttggtgagcccagcatactgcacgcaagaatcaagagaggaaatccctgggggagaagctcgaacagatccccctgatggtcagcaagattcagagtgcaacaggaacaaagaaaaaactttaggaaaagaagttttattactgatgcaagccctaaacaccctttcaaccccagaggagaagctggcagctctctgtaagaaatatgctgatcttctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcaaacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacatgcctagaatcctaagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaacttaaaaaaaa

SEQ ID NO: 283034 - DNA, 447 bp, Homo sapiens
aaaatcgcctgatgatgcatgtgaagggctggaatgaagttgttttaatacatgggaatggaaacagacactattccaaggatgacagattatcttatatgtggttttaaaatatgtctatacaagtaaataaatattacatgtacactgtagattatgtcaccaatatttctagaggtttacattttcaccttcccttttctggttcaccttggaaagtgggtgttgccgcattctgtctgggtgctggtggtacttgtttaaaatgatgctttcgtgtttaccttgaaccatggtgtagaaagaatcgatcgaggacagatttgaagtgatgctgacatcttcttctcggctagatgactcaatgtccactgtgatagccttgtccatgtccccatgcagcaccagagaaaatttcaaaaatgatggtgtcgtctgaagaaagaa

SEQ ID NO: 283035 - DNA, 1251 bp, Homo sapiens
  misc_feature (2)..(4): n is a, c, g, or t
  misc_feature (8)..(8): n is a, c, g, or t
  misc_feature (11)..(11): n is a, c, g, or t
  misc_feature (13)..(13): n is a, c, g, or t
gnnntggncgngncgcaggacctgggcgtggggacaccaccaggcaggagcagaggcaggactgggacgccaaaagctgagaatcctcgatgcccgcgcgagagccccgtgttatggcgagttctggaggctgggaagttcaagaccaatgcacgagaatttggtctaaagagaatcttcttgctctgaacacacatagtagaaggcagaagggcaagagagagaacaaagtctgtgtctccacatggcagaagagcagaggagacagaacctactcctctatggcaaccaccccatcaatgacaaaaatcctagaaggatgtatgtataggaagttgaagtgttgagaagagaatggctcagagtcaagcgggaacaagattcaaacttcagagagagagggaagaaaaacatttaaatatatctggcataatccaagactatttacgacaagtgttctgtgtttctaataataaaacagacttcacctcggagtacctgcagaactgggaccccaatgaccagggagaatgaagaacaacttgttgaaggtatagagaaggcagcaaatcatacaagaaggtccatcccaaaccagagatagtatagataaatctctcatgttaactatggaaaaaataaaggaagatgacgtattttaatagaagggaaattgcgcttattgggagtaagaacactgaattgactgaatatcttaaagagagttaggaagtgaaattctcaacaggtgattattctttgaccaattttgtcttatctcttatccacattcttccctgctcttcccaatacatgtgtaagaatatccaagggcacacacataccataagcaggaatggtgtcctaaggaaagtcaatatagagagtaagaagtatatctgtcacaatgtgtacatgtatacatcctaaatatttgtacaattaatttacttctcttcatttccaacactcctagtctatgctatgaacatctcttacctaaaatgctacagatgtcccctaaatttttccataaatcagttttttcctctccaagctgtaagcagaaatgcatttttaaattgcagatatgaccgtgacacgtatctgtctcagtttatagaacaggtctctaacagggccagcagcttccagtcacttctgtcccttaccttttctccagtctcattttacatatttttttacatgctctctatattcctgtaattaaatattactttcccctcaatg

SEQ ID NO: 283036 - DNA, 231 bp, Homo sapiens
gcggccgccggaagccgactgggccctctgggcagccaatgcccgcccgccgtagtggagcccgagcgagggtcgcggggcccctgtccgcgctgggcgcagactctcctgcaccctccggggatggggcctcggaaacggacactgaggggcgtcccgcttgcgagcctaagtccatggaggcccaaatgtggaaagccgtctcgcatcctgggaaaggcttccttgcca

SEQ ID NO: 283037 - DNA, 1109 bp, Homo sapiens
agcaggatccctgcgtgcgatatttattgatataggaaaatgcttacagaatgtattaggagtatcttacacttttttaataattatgtatgtaatacatgaatagattctccttgtaaaaaacaaactcaaacacacagaaaaagttaatgactcccttgatgactgccagtttgaagtgtttttccagaccttaaaaaaatatactttcatacaagcatatgtacatatagaaagatatactttaatggggcatctttcatcataaattggatcataatgtgcaaattgtgtcacaacttttattctctgtttgttttcagacagggtctcactttgttgcccaggctggagtgcaatggcgcaatcatggctcactgcgccctccacctcccaggctcaagccatcctcctatctcagcctcctgagtagttgagacaacaggcatgtgccaccatgtctggctaatattttaataaaattttttgtagagacaggttctccatatgttgcccaggctttgattcttctaatgctcggtattaagactctatgactgtgtattatacatagagtttacatgtgagtaagttctgggtggagagacactattccttgctagggccttaagagtctggctgcagctctgctatcacatgggcaaaaccagctacataatttacaagatccagtgcaaaataaaaatgtgacatttcttgttaaaaatcattgtgaatttcaagatggcaacaacaaagcattaaaccaagcagggggcctttctaagcttgagcccccgtgtgactgcacaggtcatatgcccatgaagctggctctgcagagactagctgaccgttggactggctgtgtcctggattcttttagttaatgcattccgtgttctgacaatggacattcctgtctcagcctccacattggatctggtcccctgattctgcacccaacattcctcagccacattccctgctccaaagccagagctctatgtattccagcacaagcaaagtcccagggtccatgcctgccagtcagcattgctctggaggcacccacaaagatggcaaagatggggggtgaagggggtatt

SEQ ID NO: 283038 - DNA, 340 bp, Homo sapiens
cccggcggtgctgccctcctaggccccgggaaggccggccggcaggggcgggggcaggagtcgccgactctgggggtgctccgagctcgtgctgcggtcccactgtgcgccctgtcgccgccaccgcggaaaacgtcttgcacgtgcgaggggcatttcaggagtttcctgtctgtcaggctggagtgcaatggcgcaatcatggctcactgcgccctccacctcccaggctcaagccatcctcctatctcagcctcctgagtagttgagacaacaggcatgtgccaccatgtctggctaatattttaataaaattttttgtagagacaggttctccata

SEQ ID NO: 283039 - DNA, 246 bp, Homo sapiens
cagcaaaaattgttaaacaagtaagttaaagctaagtagttaaattgcaataaaatctataacaagttcacacgtccttttgcgtcgattcatctcaagtacaaaacatcaaaaaatttgaaagtaggtttttaactcttaaagtacatgacttatgaatccaagtttccttttttaagaaaaaaactaagtaaactgctttttaaaaatcaggaattctacttgatgtttttaatatgaaagata

SEQ ID NO: 283040 - DNA, 325 bp, Homo sapiens
gctccgcgttctccattttgggccacccatggggggggggggtctccgtagaggccccgagggagagttgggcgagggaaggaagagaaaatcttcagcgagggtagtcgaaaagaagagccctgcggtagaaagccactctaggagtaggagtgtattggacctttgaccgccaagagctctttactcgggggagaaaaactcgaggagggcctatcccctccaaagcgccgctttttccttggacaggaagaagtgacctattgcagtgtctccattgctgttatagaagttcgtagattcataaaatagtgtttgcttaaga

SEQ ID NO: 283041 - DNA, 1119 bp, Homo sapiens
ggttaactcaagatatatcttcctagtattcctgtgagttaattccctaaactttcttttccacatccaaagtcagaaaacatccacatgccatgaaattcacccttcttaaaaccctgtgatctctagatagtctttccttcatcagacccttgagcaaaattgaatgcagatgttctcttttcttttcttttttctgatatttgctaaactactgttttgattgtcctgtactttaaatttccattcaataaattattgctacataatattaatactgtaaagatctaatattaaaatagaattaattggtaaggactcctttaaactactcccttctcctcataccaaatcaggatagctttaaatagccatgagttggcaataatgactttcctttgttccttttattgcaagttaattgagcctgtcagaacatctctgctaaacaaacatacttctggaccagtgattcacagtcttgggcttcaaattagaattacctgggaagtttgaagactcccagagctgacacagcacccccagaataattagaatctcaaggtgagacccaggaatcgggatttttcaaaagttctccgggtgatctaaatgtgcaactactactgagaactactggtgtggagtttaagtgtgaaagatgaaagatttttgctttcccatttctgataaataaatctaaggtaaagtttcggcactggctacgggaaatatgtttaagactttatgatattaaaggactagctagaaacgtctagggcaaaaagcaaaaagttgctgccatctctttaatattggtcctttcacatcaacatggatggcacgtctgtgttaagaggaagatagaactggtacgatgttggaactttgaaagagagtctccttctgacaccatgtgattcctatgacaagacagactctttcattaataaaatctcctaagatgctgccaaccaaatgactgccttgagattcttctgccagcctaatgattcccgagcctaggaatccctgctatgggtgctggtagttgtgaagctggcactaatgggtctcctaggtattacagaaagcaacagcacctagcagaattcctag

SEQ ID NO: 283042 - DNA, 943 bp, Homo sapiens
agggggcgcggcttcgccttcaccgtcggctccctgctcctgtcagaacctcggtgacggttggccagttacagtggctctgaaatgagagaaattgcagaaattctccctgctcaggaaaaggtagaggcaaggattgacttaaagatgggtaagaagcctgttactgatcataagctaaatgtggacaaagtaattaaaaatattaacacaatttcttcggagttgaagaagataaaagttaattgagcctgtcagaacatctctgctaaacaaacatacttctggaccagtgattcacagtcttgggcttcaaattagaattacctgggaagtttgaagactcccagagctgacacagcacccccagaataattagaatctcaaggtgagacccaggaatcgggatttttcaaaagttctccgggtgatctaaatgtgcaactactactgagaactactggtgtggagtttaagtgtgaaagatgaaagatttttgctttcccatttctgataaataaatctaaggtaaagtttcggcactggctacgggaaatatgtttaagactttatgatattaaaggactagctagaaacgtctagggcaaaaagcaaaaagttgctgccatctctttaatattggtcctttcacatcaacatggatggcacgtctgtgttaagaggaagatagaactggtacgatgttggaactttgaaagagagtctccttctgacaccatgtgattcctatgacaagacagactctttcattaataaaatctcctaagatgctgccaaccaaatgactgccttgagattcttctgccagcctaatgattcccgagcctaggaatccctgctatgggtgctggtagttgtgaagctggcactaatgggtctcctaggtattacagaaagcaacagcacctagcagaattcctag

SEQ ID NO: 283043 - DNA, 389 bp, Homo sapiens
ttcctcccctaaatagtaatgtcagcagccaacctttacagaatttaccataatccaggactcttctaagagctctgcataaatgaactctcttcatcataatcctatgagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaacaagcaaaaaatgt

SEQ ID NO: 283044 - DNA, 693 bp, Homo sapiens
agggggcgcggcttcgccttcaccgtcggctccctgctcctgtcagaacctcggtgacggttggccagttacagtggctctgaaatgagagaaattgcagaaattctccctgctcaggaaaaggtagaggcaaggattgacttaaagatgggtaagaagcctgttactgatcataagctaaatgtggacaaagtaattaaaaatattaacacaatttcttcggagttgaagaagataaaagatttgcatcacatgctgatgcttacagcagccacagctaaggggactgggactgccaagaccagtttggaccactcagaacttactacaggagctggggaaaggaacacctcaaacaaaatcaagctgtgactccaagaagaagagggcatggccgttcgttaggcaccaaataagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaacaagcaaaaaatgt

SEQ ID NO: 283045 - DNA, 1426 bp, Homo sapiens
acacaccattcaagactatgtcacattcagcaaaattcattgtctttataaattcttactaagcccctaaggtccattccaaattaaaaagtataaattagattctgtgacttaaagcttcttcattttaaacagattcatatagtaggattagaccttataggtcatgatgtttagtcgctcacctcacagacatattcagttattttatcccaagaaaatttctgtgattgaatatttctagggataatctatccctgaccaaacatttcttatgctggggaacttcctgtctcactagtcaatccattctattttaaacaattccttctcaccagctagctgaaatctgttcccctattgctttcacctaagagtcctatttctaaccatgaaaactacactgaatatgtagttattctttttaaaacaactcttgggtatttaaagataacctgtgtcagttatgaggcctacatctataagtaacaaaaaaaccaacttaacttatacaataaggaaaaacaagaagatccaaggtagcagagccctaaagttaattcagaggtttaaagattttgtcagggaccaggctctttccatctttctgctctgtcatgttcactctctttattacccctcatgatcattaccttcagaggtgctcatatatagacagtctctttttataagtctcctcccagatccctccagcacagttccctttcattggccagatttgcatcacatgctgatgcttacagcagccacagctaaggggactgggactgccaagaccagtttggaccactcagaacttactacaggagctggggaaaggaacacctcaaacaaaatcaagctgtgactccaagaagaagagggcatggccgttcgttaggcaccaaatacttcaacaccacagtgaagattctccttctaaaatgcgaatctgcagaaaaccctcattggctcaccattgtcctcaggataaagtctaaacatcttagaatggactatatgacctgctcagatcattcccctcctttcccctctagtctcttactctgttcttactgcatgttctatgctccagctgtactgaactatttgcatatctccacaagtgcttttctgtatctgtttcaacacatacttgtctgtctgaaatcccattgctataccctacctccaacacaccaggttaactgctagtagtcaaggtctcttacaatggaaaactttttttgagccagcatgttatcctttctgccttttgctatcacctgttatactattttataattgcatatttccttacttttcttatccctgctcaactgtaagctccttatgggtatttctagtacttaacacggtgccttgattgattcgattcttaaaaaatttttattaaatgaataaa

SEQ ID NO: 283046 - DNA, 930 bp, Homo sapiens
agggggcgcggcttcgccttcaccgtcggctccctgctcctgtcagaacctcggtgacggttggccagttacagtggctctgaaatgagagaaattgcagaaattctccctgctcaggaaaaggtagaggcaaggattgacttaaagatgggtaagaagcctgttactgatcataagctaaatgtggacaaagtaattaaaaatattaacacaatttcttcggagttgaagaagataaaagatttgcatcacatgctgatgcttacagcagccacagctaaggggactgggactgccaagaccagtttggaccactcagaacttactacaggagctggggaaaggaacacctcaaacaaaatcaagctgtgactccaagaagaagagggcatggccgttcgttaggcaccaaatacttcaacaccacagtgaagattctccttctaaaatgcgaatctgcagaaaaccctcattggctcaccattgtcctcaggataaagtctaaacatcttagaatggactatatgacctgctcagatcattcccctcctttcccctctagtctcttactctgttcttactgcatgttctatgctccagctgtactgaactatttgcatatctccacaagtgcttttctgtatctgtttcaacacatacttgtctgtctgaaatcccattgctataccctacctccaacacaccaggttaactgctagtagtcaaggtctcttacaatggaaaactttttttgagccagcatgttatcctttctgccttttgctatcacctgttatactattttataattgcatatttccttacttttcttatccctgctcaactgtaagctccttatgggtatttctagtacttaacacggtgccttgattgattcgattcttaaaaaatttttattaaatgaataaa

SEQ ID NO: 283047 - DNA, 580 bp, Homo sapiens
agggggcgcggcttcgccttcaccgtcggctccctgctcctgtcagaacctcggtgacggttggccagttacagtggctctgaaatgagagaaattgcagaaattctccctgctcaggaaaaggtagaggcaaggattgacttaaagatgggtaagaagcctgttactgatcataagctaaatgtggaccagtttggaccactcagaacttactacaggagctggggaaaggaacacctcaaacaaaatcaagctgtgactccaagaagaagagggcatggccgttcgttaggcaccaaataagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaacaagcaaaaaatgt

SEQ ID NO: 283048 - DNA, 322 bp, Homo sapiens
tctcttacaatggaaaactttttttgagccagcatgttatcctttctgccttttgctatcacctgttatactattttataattgcatatttccttacttttcttatccctgctcaactgtaagctccttatgggtatttctagtacttaacacggtgccttgattgattcgattcttaaaaaatttttattaaatgaataaatggttctggatgcttgaactcatttaaaacagttaagaagctttagattccccccaaacttgattatctaattgttctagtttggagaatattctttcataaaataaaatgtaataacta

SEQ ID NO: 283049 - DNA, 492 bp, Homo sapiens
cactctctttattacccctcatgatcattaccttcagaggtgctcatatatagacagtctctttttataagtctcctcccagatccctccagcacagttccctttcattggccagatttgcatcacatgctgatgcttacagcagccacagctaaggggactgggactgccaagaccagtttggaccactcagaacttactacaggagctggggaaaggaacacctcaaacaaaatcaagctgtgactccaagaagaagagggcatggccgttcgttaggcaccaaatagtgagtgcctaatatgctttttccatgtgttctccctaggacagcatttcctggactttgatctgtgaaccctgctgtttcaagcaatgttaatagatggtgtacagtagaacagagtcaatgttcttatggccaaataagtttggaaagtgctttatgctacatattttacaaatttacagtacatattaagaaatctgact

SEQ ID NO: 283050 - DNA, 472 bp, Homo sapiens
ccaccttccaccacccaacggttacagtggctctgaaatgagagaaattgcagaaattctccctgctcaggaaaaggtagaggcaaggattgacttaaagatgggtaagaagcctgttactgatcataagctaaatgtggacaaagtaattaaaaatattaacacaatttcttcggagttgaagaagataaaagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaacaagcaaaaaatgt

SEQ ID NO: 283051 - DNA, 497 bp, Homo sapiens
cctgatttttattcttagagcaatttcttatatgggtctttatataacatttaaagggcagaataatagacaatatctccccggatactttttatcagcaagacaggaatgttccccaaatgacactgcttaagagaactttgaggagaactgagggcaagatacaagccatggttctatacagataagtctacggaagctgcagaaataacattccagatccccaggaatccacccacccacccctccgactttggccgaacaccatggctggctgccgtgtgaagaatggactgtagggggtgccagagtggctgtgggaaacatcccctagaaatctagaattcaaagcacttactttgagtgatatatccacaagaaagagccttctgtgctaaaagcaaaaaagaaataaaaacatatcatgttacttttaattctgagaaaggcgattttgtaaccattatcactgagcccggggctgagctaagagcctg

SEQ ID NO: 283052 - DNA, 481 bp, Homo sapiens
gcaaatttccaagggcacatgacatgtgggcacaaaagccgggatttcacaccaggggataaagtatatcagaaatgaaggctgggacaggaatgttccccaaatgacactgcttaagagaactttgaggagaactgagggcaagatacaagccatggttctatacagataagtctacggaagctgcagaaataacattccagatccccaggaatccacccacccacccctccgactttggccgaacaccatggctggctgccgtgtgaagaatggactgtagggggtgccagagtggctgtgggaaacatcccctagaaatctagaattcaaagcacttactttgagtgatatatccacaagaaagagccttctgtgctaaaagcaaaaaagaaataaaaacatatcatgttacttttaattctgagaaaggcgattttgtaaccattatcactgagcccggggctgagctaagagcctg

SEQ ID NO: 283053 - DNA, 1059 bp, Homo sapiens
ggaacagacgcccagtttgcgatttcaccagtctgcccttcctcgtcccgctgctcctcgtcctaaggagctctgctgccacacagcactgcgctcaccttcttcgccggcagaattgctacgctgaaagccaggccccgggaatcagggcaaacgccactgagttagaaactggcgggtcccctcagtgaaaggcagccggaacaacccccgccgctgcgcatgcgcactccgggacgcgcgcgaacacgcagcagcgagaatctacaggggcgtggtttgcgcacgcgggaactgggatctcaaccccagggctaggtgcctcctcccgctgctttccgccagctgcggggtgtgagattaatccccgccgattagcgccaggtgtactaagcgctggatggttccctgaccagatgaaacatcagccgatgttctaatgccggtcccctgggcgctgtccccgagagggaaaacctgttttctgaccccggctctagtcggcctctggaggtctgcagctgggttattttacctttgaaacggacgacacctgccccgtgcaccccagcggctcctccacacggagagatggtgtcagtcaaaggccgtctagatgacgagtttatgaaattgttcctggcccgtgccgggcacgaccttgcagagagcccagaagatgaaaccccagccttgccaggagctcacctgctaattaggaggacaacgaatcacctcacctccctagactttgcttctcctttattcagtgagggattggactagctggtccttgaggacttttcagaaagtctggttctgggagatgaccaatgggatcatcttatgctatgagctttcctggaatgacaggtaatggagagtgaggagattttacctgatatggtcctgtttgcaccatcagccagcaacatttctgggaagcatgcttattatgtaccaacataaaagcttgaatataaggtatgcagtcccaatttcctgatctcagattgaaatgttcaagctgtataacattaaattcaaagaaccatgtaa

SEQ ID NO: 283054 - DNA, 889 bp, Homo sapiens
gaggagctgggacgctggcggcagagccactgtggcagcttgagtctcgcgcgcgcaggaagcggaggtggaagttggggcgcaggaatgtggctgtccccgcctgtaaatcatggttggggaggagtcgcggaggcaccaggctggggtctgcagcgcgccatctgctgcagcacacaggaggcgctgaggctagttggagacagagtctcactgtgtcacccaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccgggtggcaaatgaatcttactataaccacttggaaccactgtgtttctggtccatcttgtgaggcccatctttggttcagagggatggaggcagaagtcatacggcagcttcacgattcgaactcaaatgtctggtcagctactcagccatctcttccaagctgtcaggtttccctaaggtaagagccatactgatatggtttggctctgtgtccccacccaaatctcatcttgaattttaatcccaataacccc

SEQ ID NO: 283055 - DNA, 822 bp, Homo sapiens
tccttgacgccgcgagcaggaccctgtctcactgaccccgtgcccacggcggtccttgcctgcttctattctcccggtttccccagtcccgagtattggaaagcgagagcgaaagcgaaagcatcctagtcgccgagacagagtctcactgtgtcacccaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccgggtaaggggagggcggagctgaggtgagaacccacatccctcatgcccagtggcagcaggacgtggaaatggtttgcccagccctcacttctcttggacagagcttgagccttctgggaaactgcttttccctggctgagtgattagcgggggtgttaagttgggaagctggacgttcacttccatgtgctcctctgagaaccatctgttggtctgatggtgctagatctgaagctggtgagcctcttgggg

SEQ ID NO: 283056 - DNA, 1333 bp, Homo sapiens
gaggagctgggacgctggcggcagagccactgtggcagcttgagtctcgcgcgcgcaggaagcggaggtggaagttggggcgcaggaatgtggctgtccccgcctgtaaatcatggttggggaggagtcgcggaggcaccaggctggggtctgcagcgcgccatctgctgcagcacacaggaggcgctgaggctagttggagacagagtctcactgtgtcacccaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccggcctttttatagccaacaagagcaaaagcacactgcaatgtccaaacgaattgcaggcgttttctgctccctgaagcctgggaattaatttatatactcagtcccttttcccttggctggccattgaagtagttgaaccacaggattggactgtccagaatcattagccagagttcactgtgagtggacgtcttttagttctgcttcaacgctataaccaacctttaccaaaagcaacaacaaaacaaaaaactgcagaaaccaatgagttctgttcacaaaggatggctcctcatgtcatcacaccggcaaggaatggacgagcctctgatttttctcttcttggctgactttacaaggttggatgcagtccatgaggatcatgcagcaaagacagaaagtgctggagaagcccaacctgcagggcctcacctttagctggtttgtgtggttccacttcatgtagctgttggaacaccagtctctctaatgtgctctatgggatagctgttaccttccactaatttatgtctaatacctataaacctaaagtatctttttaaaaattttattccgtctttttggaggaaatttttgtgcatgccagatatagtgtcaagcattgggattgctaagatgaacgtaacattgtcctcaccacccattaagtcacaatctagtagatgagtaaaagtaaa

SEQ ID NO: 283057 - DNA, 1206 bp, Homo sapiens
gaggagctgggacgctggcggcagagccactgtggcagcttgagtctcgcgcgcgcaggaagcggaggtggaagttggggcgcaggaatgtggctgtccccgcctgtaaatcatggttggggaggagtcgcggaggcaccaggctggggtctgcagcgcgccatctgctgcagcacacaggaggcgctgaggctagttggagacagagtctcactgtgtcacccaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccggcctttttatagccaacaagagcaaaagcacactgcaatgtccaaacgaattgcaggcgttttctgctccctgaagcctgggaattaatttatatactcagtcccttttcccttggctggccattgaagtagttgaaccacaggattggactgtccagaatcattagccagagttcactgtgagtggacgtcttttagttctgcttcaacgctataaccaacctttaccaaaagcaacaacaaaacaaaaaactgcagaaaccaatgagttctgttcacaaaggatggctcctcatgtcatcacaccggcaaggaatggacgagcctctgatttttctcttcttggctgactttacaaggttggatgcagtccatgaggatcatgcagcaaagacagaaagtgctggagaagcccaacctgcagggcctcacctttagctggtttgtgtggttccacttcatgtagctgttggaacaccagtctctctaatgtgctctatgggatagctgttaccttccactaatttatgtctaatacctataaacctaaagtatctttttaaaaatttta

SEQ ID NO: 283058 - DNA, 1355 bp, Homo sapiens
gaggagctgggacgctggcggcagagccactgtggcagcttgagtctcgcgcgcgcaggaagcggaggtggaagttggggcgcaggaatgtggctgtccccgcctgtaaatcatggttggggaggagtcgcggaggcaccaggctggggtctgcagcgcgccatctgctgcagcacacaggaggcgctgaggctagttggagacagagtctcactgtgtcacccaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccgggtaaggggagggcggagctgagcctttttatagccaacaagagcaaaagcacactgcaatgtccaaacgaattgcaggcgttttctgctccctgaagcctgggaattaatttatatactcagtcccttttcccttggctggccattgaagtagttgaaccacaggattggactgtccagaatcattagccagagttcactgtgagtggacgtcttttagttctgcttcaacgctataaccaacctttaccaaaagcaacaacaaaacaaaaaactgcagaaaccaatgagttctgttcacaaaggatggctcctcatgtcatcacaccggcaaggaatggacgagcctctgatttttctcttcttggctgactttacaaggttggatgcagtccatgaggatcatgcagcaaagacagaaagtgctggagaagcccaacctgcagggcctcacctttagctggtttgtgtggttccacttcatgtagctgttggaacaccagtctctctaatgtgctctatgggatagctgttaccttccactaatttatgtctaatacctataaacctaaagtatctttttaaaaattttattccgtctttttggaggaaatttttgtgcatgccagatatagtgtcaagcattgggattgctaagatgaacgtaacattgtcctcaccacccattaagtcacaatctagtagatgagtaaaagtaaa

SEQ ID NO: 283059 - DNA, 1279 bp, Homo sapiens
gaggagctgggacgctggcggcagagccactgtggcagcttgagtctcgcgcgcgcaggaagcggaggtggaagttggggcgcaggaatgtggctgtccccgcctgtaaatcatggttggggaggagtcgcggaggcaccaggctggggtctgcagcgcgccatctgctgcagcacacaggaggcgctgaggctagttggagacagagtctcactgtgtcacccaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccggcctttttatagccaacaagagcaaaagcacactgcaatgtccaaacgaattgcaggcgttttctgctccctgaagcctgggaattaatttatatactcagtcccttttcccttggctggccattgaagtagttgaaccacaggattggactgtccagaatcattagccagagttcactgtgagtggacgtcttttagttctgcttcaacgctataaccaacctttaccaaaagcaacaacaaaacaaaaaacggcaaggaatggacgagcctctgatttttctcttcttggctgactttacaaggttggatgcagtccatgaggatcatgcagcaaagacagaaagtgctggagaagcccaacctgcagggcctcacctttagctggtttgtgtggttccacttcatgtagctgttggaacaccagtctctctaatgtgctctatgggatagctgttaccttccactaatttatgtctaatacctataaacctaaagtatctttttaaaaattttattccgtctttttggaggaaatttttgtgcatgccagatatagtgtcaagcattgggattgctaagatgaacgtaacattgtcctcaccacccattaagtcacaatctagtagatgagtaaaagtaaa

SEQ ID NO: 283060 - DNA, 821 bp, Homo sapiens
atatgaatgttttcatttctttcgcatatatagccaggagaagaagtgctagaacacagtaactgtatgtttaacattttgaggaaatgacaagcttttccaaagtggctacaccatttcacattcctaccagcagcatttgaagatacccagttcttcatatcctcaccaacaaaatgtttaggtaatttgttatgcagcaataggtaactaatacatcattttggtagatgcggtacaaatgtcttcataaaattcaacatccttttaaaatttaagaaaaaaattcaaccaagactcaaaaacaagatattttaaactttctcccagtattgagaacaaacacatttacctacaattaccaccttaattcaacacttgtactgacaatcctaaccaattcggtaagaaaagcaaataaacggcataggaattggaaaggaagaaatgatgtatcacgtaaaatatactcataggaaatttaaaatagtcttcagatattagaagaaaaaagagggtttgctaagtctctggacataaatcaatagatgaaaatcagctgtttttctataggccagcaacagagtataattttttaaaagaatatcatttatctctgggcatggtggctcacgcctgtaatcccatcactttgggatgccgaggcaggtggattgtgaggtcaggagattgagaccatcctcgctaacacggtgaaacccgtctctactaaataaaacacaaaaaaattagccgggcttggtggcgggcgcctgtagtcccagctactcaggagactgaggcaggagaatggcgtgaac

SEQ ID NO: 283061 - DNA, 635 bp, Homo sapiens
ccctccagtccggcgccggatcgcggttgcccagcgcgctgtgccctgccgggggcgggccacgtttgatctccgggcccgcagcaagggatcgcgaaggtattgatctaggcgctgctgtgaagggaatttgcagatgtaattggcctaaatcagttggctttaatatcaggaaattgtcctcagtgggcatggccatatggagcccttacaagggactgggctcttcctggtgaaaaagatttgaatcacgagagtggctgatatgagggaaattctttgctgttgccttcgaagacagaagaggtccacaaggcaaaggatgcagacagcctgtaggagctgagactggctcctggctgacagccagcaaggaaatgaggacctcagtcctccaatcatgaagcagactccgacttctgctaacaacctgaatacacttcaaagaggattctgagctccagccgcctacacattgatttcagctgttgggaccctcagccgagaacccagctatgccgtgcccagatgtaagacctacacatctgtgagcttgtaagtgtgtgttgctttaagccactaagtttgtggtaatatgtttcactgcaatatgaaactaatacttctgtgtgcag

SEQ ID NO: 283062 - DNA, 1930 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaagaaaaaaaag

SEQ ID NO: 283063 - DNA, 4345 bp, Homo sapiens
  misc_feature (450)..(450): n is a, c, g, or t
  misc_feature (1624)..(1624): n is a, c, g, or t
  misc_feature (1815)..(1815): n is a, c, g, or t
  misc_feature (2053)..(2053): n is a, c, g, or t
  misc_feature (2067)..(2067): n is a, c, g, or t
  misc_feature (2070)..(2070): n is a, c, g, or t
agttgctgccggagaagtgtgctctgatgtggctacatttggggacgcgggctccccagaggcccaagcgagaaagccgggggttcccaggctgggggtgcaggacgggccaggcactgccctgcagggcccgcccccctgcccctgcaccctcacacccatcttcctctctcagcctgaccccagggcctgggagcccccggcagaccggccctccttgccaaacagtggctgccctttatggactcggcgcctggcagagccactgtggaggaggagttggctgtcatggtcaggggaggcagcccttgggttgtcaaggttggtggtcaacgttgaacccatatctgctggaatctcccggtctgttccacacacgatcatgcgggaagctctgggacccgaaggctgttctgatctcgggggtcacaagttctcacagcagcctgnggtcaccagggaccagacccggcgttagcctctgtaaggagctgcctggctgctgggctgagctttgttgcaggcccaggaagatgaccaagaaggacagagcagagccccatctaccactgctgggagggcctgagggagcacgtgcacagcagagccccatcctccactccctgggctcgaagaggcttcctcggtgtggatggcagctgttaacgagcagtggtggtgcagctggaggcctctgtcccatggggcacagacgggagaaggatggcggacgggtgtgcacgcttgggaggacgggcgggcggcataggcctgagcaggtggcatgggcgcacgagaagggtgtgtctgagacaggatgtttatcccaaatgccaggagtggacgaggcggacgagtggcagtgaggtaggcatgtgaggttgttgcctggcccactctgccgaccccagaaacccagcggcctgggcccagcacccggctacacatggggtgagctcacgcccacactgtggcctgtgcccgtcacggggctgcttgcttctcctaggcttgggaacaagctggcatgaacgctgtggccgcattcacagctcaggcacttccactttgggttttatgaagaaacagacttaaagagcatttgttcctaatgggtgggctgaagcttgggaggagcattcagcttctctccacagtatggcttcacctgttcctgagcgccctgctaccctcttgctaacctgggtggctgaggtcctctgctttggtggcgttgacttcccgtctgcagccagcgccaggtgccagcccccgcctctgctcatcgggaagcgctggcctgcaggtgctttgtggttgccacggacccttgttctgtccctttccagcacccaccccccacccgctgtgcattccgtagttcattttcaaggcagggggcacatggtgaaaatacagcctggctttttttcaacaaatgcagctgcactcttccttgcttgttttgaaggctgagccagcaacctccttggcacctggggacagtcgcttcctcagtttctgcgtaccgactgcctcacctgacacgcggcctgggcgcgagagaagccaaccaggtgcctgagttgactgactccttccgccctccagcttcctccctccnccctccaacctcctccctccaccctccaacctcctccctccgccctccaacctcctccctctgccctgcaacctcctcccctctgccctccaacctcctccctccgccctccaatctcctccctctgccctgcatcctcctcccctccgccctccaacctcctccctccgccctccaacctcctccctccnccctccaacctcctccctccgccctctgccctcctccctctgccctccagcgttctccctcctccctccaccctgtttcctccctccacctcttctctcctccctccaccctcttccttctaccctcttccctctgccctcttcttctgccctcctccctccaccctctttcctccctcctccctccaccctctgccctcctccctctaccccctgccctcctccctccgccttatcnggaatcggggtctnggncctgggctggaggcagaccctggcccgggcgaggttaaaggtactgcaggagggcggcatcatgatgtcctgaagcttgttgcgcccggtgctgtcggccggctgaaggcagaaacagtcacagcacctgcagctatggaaggcgacgactgaaaatctaataggcaccttgatgtcaagtttccaagaccaaaggcaagaacagtcagatcaaacttcggaagagtcagagaaagtgagcatgacctagaggagggagacggtccttccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283064 - DNA, 1298 bp, Homo sapiens
ggtcagtttctccctatggaactactgggcttttagaatgataggaaacctggcctgtccctttacaggtgcgttacagtcaggcgaagctgggctgcgtgaccctgggcagggtgggcggctctcacctgtggagatgcagcactgaggggcccctccagcgtggttgctaacacagactgcctaggagcgtgcttttctcatcctggaccccagctactgcttaatttgcaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaagaaaaaaaag

SEQ ID NO: 283065 - DNA, 3999 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283066 - DNA, 3906 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283067 - DNA, 3920 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283068 - DNA, 3975 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283069 - DNA, 2368 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattgcgcagctctgcagcggaaggaccttcagtaaagacgctggtttgtaacgagagaagcgttccaaagtgtcacacgacattgtttattactaaaaggagcagaatttctttttaatcttgacagtgttgttttcgtaacagtatgatttaaactgttacattcatttaggaaaactttttttcatttcataagtaatcaagctatctttccagcttaaaagcaaagaaaaaaggctcagggtaactttttaaaccacttcatcaataagaaaagttctctctgtcattgcacggcgtgattgtacacagtattagcaagcagttcacatgcgccagggccgacttggaaggaaacacaggttaacactgtttcctgtccgagttcacagagatgtttgca

SEQ ID NO: 283070 - DNA, 1745 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagccccaccagaccaggcggcgagaaggaacagggagtgaacatgtaacggaaaacaataaaactgaatttaactggaaaaaaaaaaaa

SEQ ID NO: 283071 - DNA, 426 bp, Homo sapiens
agtccaaggtcttggagatgttctcctgttttattcttgaggtttgagcttagctagctgggctcttagcaggatggttttggtagttcatagatcagattaaatggtatttaatttgtgagcagtaagtgctcacaaaacagaaatcagtgtaaaaattggattttgtttgttgttgtcgtctttagaacaaccagaaattaagcaggttgatagtgtctttttgtttatttcattttagatcaacaggcggtccttcgggtcggagtggacatcggatggtggcctggaagagacaattgatcctgtttggtggcttccatgaaagtacacggttggtaccaagaacggaaaaatctttctctcctgaagcattaaggagtgggctttttatagaaagagcattctgaatacacaagaaagacg

SEQ ID NO: 283072 - DNA, 354 bp, Homo sapiens
gaaaacccggtgttctctctacccctcctgcacgggcctccccctcggctgaatgtgtttctctctcattccttcctccttgcgtatcagaaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaag

SEQ ID NO: 283073 - DNA, 1837 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaagaaaaaaaag

SEQ ID NO: 283074 - DNA, 831 bp, Homo sapiens
tttttgaaacaaacggagacgtttaattacatgaacgcacacatgttaaaaaccgcctgtgcactcccggagggcagagcctgcctctctggttatttttgtgtcctccattcacttacaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattgcgcagctctgcagcggaaggaccttcagtaaagacgctggtttgtaacgagagaagcgttccaaagtgtcacacgacattgtttattactaaaaggagcagaatttctttttaatcttgacagtgttgttttcgtaacagtatgatttaaactgttacattcatttaggaaaactttttttcatttcataagtaatcaagctatctttccagcttaaaagcaaagaaaaaaggctcagggtaactttttaaaccacttcatcaataagaaaagttctctctgtcattgcacggcgtgattgtacacagtattagcaagcagttcacatgcgccagggccgacttggaaggaaacacaggttaacactgtttcctgtccgagttcacagagatgtttgca

SEQ ID NO: 283075 - DNA, 4000 bp, Homo sapiens
  misc_feature (19)..(19): n is a, c, g, or t
  misc_feature (27)..(27): n is a, c, g, or t
gtgggttacccggcccccnggagttanggcatatgtcgaccagcgctcggtcgtaactaggcgtggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283076 - DNA, 3829 bp, Homo sapiens
  misc_feature (19)..(19): n is a, c, g, or t
  misc_feature (27)..(27): n is a, c, g, or t
gtgggttacccggcccccnggagttanggcatatgtcgaccagcgctcggtcgtaactaggcgtggtgtcccgtcgcggcttgggacccggcaagatgggcaagaagggcaagaaggagaagaagggccgcggcgcggagaagacggccgccaagatggagaagaaggtgtctaagcgctcgcggaaggaggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctccttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaaaaaaaa

SEQ ID NO: 283077 - DNA, 1760 bp, Homo sapiens
  misc_feature (19)..(19): n is a, c, g, or t
  misc_feature (27)..(27): n is a, c, g, or t
gtgggttacccggcccccnggagttanggcatatgtcgaccagcgctcggtcgtaactaggcgtggtgtcccgtcgcggcttgggacccggcaagatgggcaagaagggcaagaaggagaagaagggccgcggcgcggagaagacggccgccaagatggagaagaaggtgtctaagcgctcgcggaaggaggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaagaaaaaaaag

SEQ ID NO: 283078 - DNA, 3107 bp, Homo sapiens
ggcgcgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctgatgaaaaagttaataaacagaatggcgactccgatgttgagcaagatcaccatgaccaccaggataggcgctgagccctggaagagagcgaggggaagaggtgagcgacagctgcggggggctctgcctgggccaccacgcctcccacccacgtcttttcaccaagctagca

SEQ ID NO: 283079 - DNA, 148 bp, Homo sapiens
cccccacctgcctcagctgcgctgacgtgtatgtgcgttcattctgcttttgaagaaactcaggagtggctggaggagacggactcggaagaggacagtgaggaggttgagggcgccgagggtggggtcgacgacgaagacagcggag

SEQ ID NO: 283080 - DNA, 334 bp, Homo sapiens
ataagtaagttcaggacaagcttagatgcaaattcacctttagcggctgcctgggtctaggttccctcagagagctggggcctgtagcagcagcattagtaggacatcttgaagcaggttttgtgctttgcaaagggtgtgttatttaaaaacaaagaaagcaaaaagtctttaaaagttaacttagagccaagttggtagactccttttgtaagagtgtattgtaggcgtgatgactcatgcctataatcccaacactttgggaggctgaggttagcttgagtccaggagtttaagaccagcctgggcaacatagtgagacccctgtctctac

SEQ ID NO: 283081 - DNA, 281 bp, Homo sapiens
  misc_feature (41)..(41): n is a, c, g, or t
ctccaacccttctataaagactagttgaagagaggagagancccgcttttattggtaacgggcgataagaggataaatgctacatggaagtgcttgtcacttatgaaccccaacgcaagtctcatttcattgttccgcaagcgatttatgaacgtgcctgtgggcagcagtaagaaaagaaaaattgaagcatgagagatgagcattgctgtcaagtccccacagctgccacagaaacgcatgtgctgctttccatcatcccttgcattcaaaatgctact

SEQ ID NO: 283082 - DNA, 5607 bp, Homo sapiens
  misc_feature (434)..(434): n is a, c, g, or t
  misc_feature (1163)..(1163): n is a, c, g, or t
gccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatganattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactangtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgccgctaaaggatgaccctggacgaggagaagggggcgcatcctggagcaggcgcggcagggcgcgctcgccgggccgggggccgcgaacagaggcgtgcgcgaaggcgaggaagggcgggcgcctctggacggaggcgagaacggaatgtgacgccggcagtgcagctacacggtctacgc

SEQ ID NO: 283083 - DNA, 2831 bp, Homo sapiens
  misc_feature (434)..(434): n is a, c, g, or t
  misc_feature (1163)..(1163): n is a, c, g, or t
gccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatganattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactangtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgccgctaaaggatgaccctggacgaggagaagggggcgcatcctggagcaggcgcggcagggcgcgctcgccgggccgggggccgcgaacagaggcgtgcgcgaaggcgaggaagggcgggcgcctctggacggaggcgagaacggaatgtgacgccggcagtgcagctacacggtctacgc

SEQ ID NO: 283084 - DNA, 737 bp, Homo sapiens
actaaaagtgatgaaactggatggacaacgttttttgagtaagtatatgaaaattctactctgattataaaatactgtgatataataatatcatctataataacaatataatcttaagagctggaggattccatgtttttgagagtctagagcttctgtaatttttggatcccggctgggcacggtggctcattcccgtagtctcagctcctggggaggctgagacgggaggattgcttgagcccaggacttcgaggccacagtgagctatgattgtgccactgcactccaggctgagtgacagagccagaacgtatctctaaagaaaaaaaaatggccgggcgcagtggctcacgcctgtaatcccagcactttgggaggccgaggcgggcggatcacgaggtcagaagatcgagaccatcctggataacacggtgaaacccccgtctctactaaaaatacaaaaaaaatagccgggcgtggtggcgggcgcctgtagtcccagctactcgggaggctgaggcaggagaatggcgtgaacccgggaggcgcagcttgcagtgagccgagatcgcgccactgcactccagtctctgggcgacagagcgagactccgcctcaaaaaaaaaaagatacctctttctgagaaagaagacaaaattgcaagatacaagatgtagggccttggaaagggaagggactcgtgtaagggagaagcccaaagcttaagtttcagt

SEQ ID NO: 283085 - DNA, 439 bp, Homo sapiens
gcggccgccaccagccggaatagcaaccggcggagcccgtgcgcaccgcagcgcagcgcagcggccggggggtgcgggcgccctcgccgcccggctacctaccgccgcctgggcgccgccgctgcctcccttccccgcttctaccctccagcagacgcccgccggagcgacccctcccagggtgaccgggggaaggtgttccacgtggccatagcgtttgcgtcacaatgacctggcggacaggtgggagccacagcgtacaccccaggattccctctgtgctgtgcgtagtgcctactgcttgcttccaggttaaatttctgtagctttagaggacaggagacttcatgacttcactgccaagaaaagttacagaggcctgctgtacctggaaatcaagtttgagcttcgagaataaaggtcatgttttaaaaacagc

SEQ ID NO: 283086 - DNA, 329 bp, Homo sapiens
ctgcaggtgactggaactgatttgacataaccatcgtatgcatggagaagctgagaacagtaatctgcagaagcaaaagtatgaaacagccgggcaaagatgcacagaggggtcaaagcatcgtagaaccacagatgtgaaagaactgcggagaggacgttctccaggagggacatcattaactcaacccgggcgagagactaggctttgaccaggctttccaacccacgcagcttcagcttccatcaagcccatcctaaccacaacgaacacaaggcaaggcaaacaagcaaaacataataaagatcagagagaacacagaaagactg

SEQ ID NO: 283087 - DNA, 8096 bp, Homo sapiens
  misc_feature (4166)..(4166): n is a, c, g, or t
  misc_feature (4571)..(4571): n is a, c, g, or t
  misc_feature (4593)..(4593): n is a, c, g, or t
  misc_feature (5084)..(5084): n is a, c, g, or t
  misc_feature (5246)..(5246): n is a, c, g, or t
  misc_feature (6013)..(6013): n is a, c, g, or t
  misc_feature (6495)..(6495): n is a, c, g, or t
  misc_feature (6512)..(6512): n is a, c, g, or t
  misc_feature (6532)..(6532): n is a, c, g, or t
  misc_feature (6547)..(6547): n is a, c, g, or t
  misc_feature (6672)..(6672): n is a, c, g, or t
  misc_feature (6722)..(6722): n is a, c, g, or t
  misc_feature (6748)..(6748): n is a, c, g, or t
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggtcgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgccctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatacngattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaantttcaaggaatggtctttgacntcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttggnatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggngactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaatnaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggagattactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggcnaaggacctctataacangtatgccacctggggggtanggcaaccacatggcnctcccagctacacaaagtcgtggtttgcatgagggcatgctgcacttagagatcatgcatgagaaaaagtcacaagaaaaacaaattcttaaatttcaccatatttctgggaggggtaattgggngataagtggaggtgctttgttgatcttgttttgcgaaatccagcccctanaccaagtagattgtttgtgggtaggncagtaaatcttagcaggtgcaaacttcattcaaatgtttggagtcataaatgttatgtttctttttgttgtattaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataacgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacataggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttattcg

SEQ ID NO: 283088 - DNA, 6043 bp, Homo sapiens
  misc_feature (4166)..(4166): n is a, c, g, or t
  misc_feature (4571)..(4571): n is a, c, g, or t
  misc_feature (4593)..(4593): n is a, c, g, or t
  misc_feature (5084)..(5084): n is a, c, g, or t
  misc_feature (5246)..(5246): n is a, c, g, or t
  misc_feature (6013)..(6013): n is a, c, g, or t
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggtcgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgccctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatacngattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaantttcaaggaatggtctttgacntcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttggnatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggngactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaatnaatgaaaataaataaaaataattgggtgac

SEQ ID NO: 283089 - DNA, 775 bp, Homo sapiens
agaggccccatagatgacaggcccaggtgctttagttgggcaggacctgggagtcagtgaggaactcgccccgagaacagagaaaaggtaggcaaggagaggagatgctgatggcatctggaaacaagtcttagagatggtctgcacccagagggaataaggggagacatccccaactggaatgtgtcctggagcagctgcctgggaagaagtcctcgagtttcctcaaggtgggggacagaggtcaaggatgaggccgagctaaatggaagggcgacagtgaggcaggtgggctttaaggctgtggattcgtcatgctggcggctgccaggcactttcaggttccttggggcttgtaggggatggggacttgtcagtggaaagacgggagggatgatgtttttggacttcagtacgggtgtgatgtcccaggaagtgggtgtggctccccatcctgtatgaaataagcagtaaagcttgctcatggctgttgcacatctctgtgactcttgtttctggcaggccccactcctggcagctgagtgctgcacctgccttctcgatcacgagcctgagaactgcacgggggagcagcccagactggctggaaaccatgttttcagagtgcagggtcaagtggcgtgtaggactctgtcaaaagaatgacccctttccccaccacatacccacaactgcacaggttaaaacagaaatcttgtcattttataattgtaatccacgccgggtgcagtagctcacacctgtaatcccagca

SEQ ID NO: 283090 - DNA, 2100 bp, Homo sapiens
  misc_feature (747)..(747): n is a, c, g, or t
  misc_feature (1625)..(1625): n is a, c, g, or t
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctccgagagatctgagcccgacagccccctgtccagctgcggccacagccagcctccttgcctccatttcccgaattgcccaggaccccagctctgtgtccccaggaggcactgggggccagaagctggcccagctcccagaacttgcttctgccgagatgagtctccatgtcatctacctgcaccagcttcaccagcagcagcagcagcaggagccgtggggtgaggctgcagcctccatcctgtccaggccctgctccagcccctcacagccaccctcgcctgatgaggagaagccatcctggtcaagtgacggctccagtcctgcctctagccccagacaacagtggggaacccagaaggcccggaatctgttccccggagggtttcaggtgaccacagacacccagaaggagcctgaccgggcctcttgcactgactgagacgactcctcagggccccactcctggcagctgagtgctgcacctgccttctcgatcacgagcctgagaactgcacgggggagcagcccagactggctggaaaccatgttttcagagtgcagggtcaagtggcgtcctctggncagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctggcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcntattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccaaccaccattactttggctgtttcatctctaagagagtgtagaatgctttcacagagaccctgcacagccctgatttacagagggaagggaagcgcgggtgaggtggtggcccctggtggagctg

SEQ ID NO: 283091 - DNA, 2183 bp, Homo sapiens
  misc_feature (830)..(830): n is a, c, g, or t
  misc_feature (1708)..(1708): n is a, c, g, or t
cagcgtgcggaggacggcaagactgagctttctttgatgcggttctccctggcgcatccactctggcgccccccagggcacagctttaagtttcttgggcacctctggggccgagtacaacaagatgcagctgcctggggtgccacctcggctcgcggcccctccaccccgggggtgctcagcaactgcacctcgcccctgcctgaggccttcctggccaacctcttcgtgcaccctctcctgcctccgagagatctgagcccgacagccccctgtccagctgcggccacagccagcctccttgcctccatttcccgaattgcccaggaccccagctctgtgtccccaggaggcactgggggccagaagctggcccagctcccagaacttgcttctgccgagatgagtctccatgtcatctacctgcaccagcttcaccagcagcagcagcagcaggagccgtggggtgaggctgcagcctccatcctgtccaggccctgctccagcccctcacagccaccctcgcctgatgaggagaagccatcctggtcaagtgacggctccagtcctgcctctagccccagacaacagtggggaacccagaaggcccggaatctgttccccggagggtttcaggtgaccacagacacccagaaggagcctgaccgggcctcttgcactgactgagacgactcctcagggccccactcctggcagctgagtgctgcacctgccttctcgatcacgagcctgagaactgcacgggggagcagcccagactggctggaaaccatgttttcagagtgcagggtcaagtggcgtcctctggncagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctggcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcntattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccaaccaccattactttggctgtttcatctctaagagagtgtagaatgctttcacagagaccctgcacagccctgatttacagagggaagggaagcgcgggtgaggtggtggcccctggtggagctg

SEQ ID NO: 283092 - DNA, 954 bp, Homo sapiens
cagcgtgcggaggacggcaagactgagctttctttgatgcggttctccctggcgcatccactctggcgccccccagggcacagctttaagtttcttgggcacctctggggccgagtacaacaagatgcagctgcctggggtgccacctcggctcgcggcccctccaccccgggggtgctcagcaactgcacctcgcccctgcctgaggccttcctggccaacctcttcgtgcaccctctcctgcctccgagagatctgagcccgacagccccctgtccagctgcggccacagccagcctccttgcctccatttcccgaattgcccaggaccccagctctgtgtccccaggaggcactgggggccagaagctggcccagctcccagaacttgcttctgccgagatgagtctccatgtcatctacctgcaccagcttcaccagcagcagcagcagcaggagccgtggggtgaggctgcagcctccatcctgtccaggccctgctccagcccctcacagccaccctcgcctgatgaggagaagccatcctggtcaagtgacggctccagtcctgcctctagccccagacaacagtggggaacccagaaggcccggaatctgttccccggagggtttcaggtgaccacagacacccagaaggagcctgaccgggcctcttgcactgactgagacgactcctcagggccccactcctggcagctgagtgctgcacctgccttctcgatcacgagcctgagaactgcacgggggagcagcccagactggctggaaaccatgttttcagagtgcagggtcaagtggcgtgtaggactctgtcaaaagaatgacccctttccccaccacatacccacaactgcacaggttaaaacagaaatcttgtcattttataattgtaatccacgccgggtgcagtagctcacacctgtaatcccagca

SEQ ID NO: 283093 - DNA, 2004 bp, Homo sapiens
  misc_feature (651)..(651): n is a, c, g, or t
  misc_feature (1529)..(1529): n is a, c, g, or t
agaggccccatagatgacaggcccaggtgctttagttgggcaggacctgggagtcagtgaggaactcgccccgagaacagagaaaaggtaggcaaggagaggagatgctgatggcatctggaaacaagtcttagagatggtctgcacccagagggaataaggggagacatccccaactggaatgtgtcctggagcagctgcctgggaagaagtcctcgagtttcctcaaggtgggggacagaggtcaaggatgaggccgagctaaatggaagggcgacagtgaggcaggtgggctttaaggctgtggattcgtcatgctggcggctgccaggcactttcaggttccttggggcttgtaggggatggggacttgtcagtggaaagacgggagggatgatgtttttggacttcagtacgggtgtgatgtcccaggaagtgggtgtggctccccatcctgtatgaaataagcagtaaagcttgctcatggctgttgcacatctctgtgactcttgtttctggcaggccccactcctggcagctgagtgctgcacctgccttctcgatcacgagcctgagaactgcacgggggagcagcccagactggctggaaaccatgttttcagagtgcagggtcaagtggcgtcctctggncagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctggcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcntattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccaaccaccattactttggctgtttcatctctaagagagtgtagaatgctttcacagagaccctgcacagccctgatttacagagggaagggaagcgcgggtgaggtggtggcccctggtggagctg

SEQ ID NO: 283094 - DNA, 2893 bp, Homo sapiens
acggctaggtacgaggctgggtgttaattcggccgacctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 283095 - DNA, 2293 bp, Homo sapiens
  misc_feature (5)..(5): n is a, c, g, or t
agggnaaacaattgcaggtcgaggctggtgtaatcggacgaggcgcctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 283096 - DNA, 2902 bp, Homo sapiens
  misc_feature (5)..(5): n is a, c, g, or t
agggnaaacaattgcaggtcgaggctggtgtaatcggacgaggcgcctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 283097 - DNA, 2959 bp, Homo sapiens
  misc_feature (5)..(5): n is a, c, g, or t
agggnaaacaattgcaggtcgaggctggtgtaatcggacgaggcgcctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacagagcctcctcaacccagcctgcagcagccattacccacccgccaaggtgacaggagaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 283098 - DNA, 632 bp, Homo sapiens
ccacctcggcctcccaaagtgctaggattacactgtgagccactgcgcccagccttcaagagccccctttctttgagaagtttcttcagaagttatccatatagtagtacagacctagccattatagcacaccatcctctactatctaatgcattgatgcccagccttaagaagtctgaatattgtacgttttggggggagtcctccatgctgcctggaacagggaggagcacattgtcatgagtcgatcagaatggatcgctgatcggttcattgcctctctctctgctgcaggaggaaggatctcaggaagtcaccagcatctcacctctccaggtgggcaattaacgatggcgagggcacaccctcacccctgagcgtgccttctgcaccagcatattgcttgttggcatttttgatcaagagacttaacagactgctgagaaatttgtacctggtttttatttgttaaaataatattacgtacaaattttacaaactcatctgtgtttctcccacctaacagaacagcttttattttccgtgcatccttccagttcatccataggcatatatgtatgtatttacccatggttgtaatcttcatcgtcgcatgcatgcatgcaatttgg

SEQ ID NO: 283099 - DNA, 413 bp, Homo sapiens
gcgcgaattcgcgtcttcgtgcggaatacgtcagaggtcgtgccaggaattcgtcgtcgtggtatgtgccagcttttctcctttttcctttgaaaaacgatgcccctgcttgtggtcaggatcttccttggatatcttagggggcttgccctgtgctttatattaagtcctgacttctttccggttcaccttagcttggctattagtgtctacctcatttccgaaacctccacaagattgatattgtaattcctcttaaccttcttccactgtgtttatggtaaatatgccagaccactcaactgtagtagtagaaaaggtattgaggttacagtgctgaagcttgttgtgtgtcctgctgtgtcctacaaaaatgttgcattctagagaatgaaaccccagagcactctgga

SEQ ID NO: 283100 - DNA, 2774 bp, Homo sapiens
  misc_feature (2238)..(2238): n is a, c, g, or t
  misc_feature (2695)..(2695): n is a, c, g, or t
gatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagtcttcaggcagtgacagtggtgggagcagcagcagcagcagcagcagcatcaacagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatncttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcancttttacaccttctagtagctcaagctagtaaaaccttgtacttctctattgcgccgccattaaaagcagcattagtgc

SEQ ID NO: 283101 - DNA, 2837 bp, Homo sapiens
  misc_feature (2301)..(2301): n is a, c, g, or t
  misc_feature (2758)..(2758): n is a, c, g, or t
gatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaacagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatncttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcancttttacaccttctagtagctcaagctagtaaaaccttgtacttctctattgcgccgccattaaaagcagcattagtgc

SEQ ID NO: 283102 - DNA, 2736 bp, Homo sapiens
  misc_feature (2200)..(2200): n is a, c, g, or t
  misc_feature (2657)..(2657): n is a, c, g, or t
gatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaacagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctatccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatncttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcancttttacaccttctagtagctcaagctagtaaaaccttgtacttctctattgcgccgccattaaaagcagcattagtgc

SEQ ID NO: 283103 - DNA, 2468 bp, Homo sapiens
  misc_feature (44)..(45): n is a, c, g, or t
  misc_feature (1932)..(1932): n is a, c, g, or t
  misc_feature (2389)..(2389): n is a, c, g, or t
tgtgcgcgcggcaaccgcgcctccctacgcccagcgcgcggagnncagtggttttatacttacactcttcaggcagtgacagtggtgggagcagcagcagcagcagcagcagcatcaacagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatncttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcancttttacaccttctagtagctcaagctagtaaaaccttgtacttctctattgcgccgccattaaaagcagcattagtgc

SEQ ID NO: 283104 - DNA, 347 bp, Homo sapiens
gttcagaaatcgttttgacagcacataattcttaaatagagtacatgcaaatttggtctttcttgcatgtccgagaacacttgcctaagaaagatgtgtgatttttctttaaacctggaaattttaagcagcttatgctatcatctcatagtaacaatctagtgaagtaattgttatatcataataccggctagtgttgccagaataagcaggtgaatgtgaccaagaggtacttttataagggttttcagggcaaataggcaaaggcagccactcttatatcaaatgttgtcatatggaagggagtacaattaggtaactcggaatcctaatttcagggagtgtaa

SEQ ID NO: 283105 - DNA, 2631 bp, Homo sapiens
  misc_feature (2095)..(2095): n is a, c, g, or t
  misc_feature (2552)..(2552): n is a, c, g, or t
gggcaaataggcaaaggcagccactcttatatcaaatgttgtcatatggaagggagtacaattaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaacagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatncttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcancttttacaccttctagtagctcaagctagtaaaaccttgtacttctctattgcgccgccattaaaagcagcattagtgc

SEQ ID NO: 283106 - DNA, 525 bp, Homo sapiens
gaagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctgggggctactacggctgcgacgaggagctggtgggtcccctgtatgcacgctccctgggcgcctcctcctactacagtctccttactgcgccgcgattcgccaggctgcacggcataagcgggtggtcaccacggattggggatccgaatccctggctccagatagacttaatgaagaagcaccggatccgggccgtggccacacagggctccttaattcttgggactgggtcacacgttacatgctact

SEQ ID NO: 283107 - DNA, 974 bp, Homo sapiens
aatttgcaaaaatttattcatatacaaatgtgcaatatcaataaaatgaccaaacaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaagatgtaggttctgaaacagggtgaggtccaggatcctgcctttctaaggagctcccacgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggccgctatgtgggttttcccaccgcagtcatcatccgtcatctgtgaccttgctgcatttactccatgctcacaccccagcagcccgcctggctttggcatcgccctcagaggcatcaaacttcccctgctgcaatgtacaagagttagccaggaagcttgcagagtgctttggttttgttttgtttttttgacatgtcgccctggctggagtaca

SEQ ID NO: 283108 - DNA, 412 bp, Homo sapiens
tttggcctattctcttcgtataagacaccaggcagattggattagggcccacactacttggcctcgctttcacttacttgcctctttaaaagccctgtttccgaatacaatcccacgctgaaatactgggggttagggcttcagcgtatgaattgtgcagggacacagtgtagcccataacaccaggagcaagtcagacccataccagacttgtggaaccctgaattggtcattttgctgaggctgcctgaggaaaacaaaaggcccaatgcgtgtccagtttcctccctggtcagccactctgtctgcatctttgaagagtaggaatgggctgggctcctatctaaaccctgagtgtgccataccattcttcccagcaacttttactttgttgactttgttggccgaggat

SEQ ID NO: 283109 - DNA, 350 bp, Homo sapiens
ggaatggatgacattaatgtgcatgcagagtctcacagtgatgccggaaggaaggatgtataggcagtgaatgaatgatctttccttgaaatgctataaaaagcaacctgcattccagtcttttcttcctggttgaagttggcagatttccatttgcagggtatgggctgcgagagtaatcagggtaacattgctgtcatttccaagagaaatcagtaggggaaagcaagggaggtctttttttttttccttttttgagacagagtttccctcttgttgcccaggttgcagtgagccgaggtcgtgccattgcactccagcctgggtgacagtgagactttgtctcaaaa

SEQ ID NO: 283110 - DNA, 2824 bp, Homo sapiens
tgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacaggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtgacgttaaccatcttgtattgtgacctgtggccgcttttctggtttaagtccttcactttttcaagaggaatggatgaaattaatgtgcatgcagagtctcacagtgatgccggaaggaaggatgtataggcagtgaatgaatgatctttccttgaaatgctataaaaagcaacctgcattccagtcttttcttcctggttgaagttggcagatttccatttgcagggtatgggctgcgagagtaatcagggtaacattgctgtcatttccaagagaaatcagtaggggaaagcaagggaggtctttttttttttcttttttgagacggagtttccctcttgttacccaggctggagtggcagtggtgtgaacacggctcactgcagcctccacctcctgggttcaagagattctcctgccccagcctcccgagtagctggtattataggtgcacaccaccacacccaactaattttttgtatttttagtagagatggggtttcatgatgttggccaagctggtctcgagctcctgaccccaggtgatccacccacctcggcctcccaaagtgctggaattataggcgtgagccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaagatgtaggttctgaaacagggtgaggtccaggatcctgcctttctaaggagctcccacgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggccgctatgtgggttttcccaccgcagtcatcatccgtcatctgtgaccttgctgcatttactccatgctcacaccccagcagcccgcctggctttggcatcgccctcagaggcatcaaacttcccctgctgcaatgtacaagagttagccaggaagcttgcagagtgctttggttttgttttgtttttttgacatgtcgccctggctggagtaca

SEQ ID NO: 283111 - DNA, 1594 bp, Homo sapiens
gaggatcccagctgattgtcacggtccaactaattttttgtatttttagtagagatggggtttcatgatgttggccaagctggtctcgagctcctgaccccaggtgatccacccacctcggcctcccaaagtgctggaattataggcgtgagccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaagatgtaggttctgaaacagggtgaggtccaggatcctgcctttctaaggagctcccacgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggccgctatgtgggttttcccaccgcagtcatcatccgtcatctgtgaccttgctgcatttactccatgctcacaccccagcagcccgcctggctttggcatcgccctcagaggcatcaaacttcccctgctgcaatgtacaagagttagccaggaagcttgcagagtgctttggttttgttttgtttttttgacatgtcgccctggctggagtaca

SEQ ID NO: 283112 - DNA, 692 bp, Homo sapiens
tttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagtgagcgtcgaatgggacctctgtggctagggcaggcctgtgtgggtggcactgagagggaggaggggagggggatgttcgcagtttccttgcgaccccagggactttctttgtccccgccatccacctccttaggcctttgggatcgccgactggtctaatgtcgccggcccttgtggctctgggaaattagcattgattaatcttcctaacaatttttgtttttatagagacaggatctccctatgttgcccaggctggtctcgaactcctgggctcaaggtatcttcctgcctcggcttcccaaagtgctgggattacaggcgtgagcccggccagctcctaataatgttaagtgcttgctaggagtcaagcgctgtgctgagcgcaggggcttcccacgtcattgcgtccccagtgcttagtgccaggcactgagcagaggcgcgattcgtatttgaactaaaacgaaccccgtccctgaggaacaagacctctactgggaagtcaaagaaat

SEQ ID NO: 283113 - DNA, 407 bp, Homo sapiens
ctgggctcctatctaaaccctgagtgtgccataccattcttcccagcaacttttactttgttgactttgttggccgaggatttcctaatcacattgttgttttcctggcagttcccaaaccagatctagattcttacgtgtttctgagagtgagagaacgacaagaaaacatactggtagaaccagacacagatgagcagaggtgagtggcgtgcatctttcacagtgggcacattcctcccgatggagggccagccgagctctgcaggcaaatgtgtttccctctttttcagggactacgtgattgacctggagaagggctcacagcacttgatccgatacaaaaccattgcacctctggttgcatctggagctgtccagctaatttaaaactaggcataaacagc

SEQ ID NO: 283114 - DNA, 414 bp, Homo sapiens
tgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaa

SEQ ID NO: 283115 - DNA, 1161 bp, Homo sapiens
gcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagagggactacgtgattgacctggagaagggctcacagcacttgatccgatacaaaaccattgcacctctggttgcatctggagctgtccagctaatttaaaactaggcataaacagccaggcatggtgactcaggcctgtaatcccagcactttgggaggccgaggcgggcggatcatgaggtcaggagttcgagaccaaccgaccaacatggtgaaaccccatctttactgaaaatacaaaataattagccgggtgttggtggtgtgcacctgtaatcccggctactcggggggccggggcaggagaatcgcttgaacctgggagcaggaggttgcagtgagccgaggtcgtgccattgcactccagcctgggtgacagtgagactttgtctcaaaa

SEQ ID NO: 283116 - DNA, 838 bp, Homo sapiens
cccccccccccgcacgcccagccacaagaagttttccggcggcggccgatccacttggcactgtgcacctgtctgattcccaaggccacagagggcatggtgctggtgaagaagtcaggtttctccatgtgggacgccagcaaccacagactgcctctcaaataaagaacctggaaccttcatgctgagaatgcactctctttcccttcctgataaagaaggctcctgctctgggccaagaaatcccaaaacacaatagtgttctcagggcacaggattgtatggctccacaccctacagggtctcacttggttgcccaggctggaaagcaatggcacaatcttggctcactgcaacctgtgcctcctaggttcaagctattctcctgcctcagccttccaaatagctgggattacaggcacatgccaccacaaccagggtcttaaaacataaatgatagtctgtgggcggtttattctctccatttcttctcatgaaggaccaaggagttgaactgaagcctgagcgtctgtataagcttttccccatgctgctcttttttgcaaacaccaacacaatttgggctccatttataaggcatctgctgcaccaaccctctttcttggtgcttactggacctgctcagggttaatttctaactcaaagaacctaacttggagtaactccgtaccaccagcaaagcgactggctttggggaatgacatttacaatgtatccactgttatttggtcacccagcaaactgtcatttttcagaaaccagggctgtctcacaaactggctttcaataaggtgggttgcttagcaactgccaagga

SEQ ID NO: 283117 - DNA, 709 bp, Homo sapiens
aatagaggtgaggtcacaacataggaaagttgcttggtgtataattagtgtggggagcacaggggggtggattacaatgcacagacaaattctaatccatagcctgtaatttgagggttgggtcaatcataatttgggtgcaagcacacctacttccttttttaataagggagaatttagctcttgttacccacaagagttctcaaagtagaaaataataaaccatgttcttgaagccagtactgaattatcaaagctgaaggaagggaagctaaagaaagattaggcaacttggggtacaaatgcgttcaaaatcctctccgtcagtatgccaagtctctggataccagtgacttatttgccctggggtgagagaaaactccattttccatcaagctggagaagcagcctttgtttttcagccatggataaggccacttattaggaggacaacaagaagtgaaatctcaggaggatgcttaccaggaatcaggaaactggaaaaacaatggcctgctgggacagatctccaagccctagaggaccacaggtgaatgtcacctgtaagtctccgctcattctagccaatgtaattctacaaaaggccacatctaaactactgaaatgcatgcaagtaattttcaaaggcctacagactctgctatgcttcagtagctgtcctatcaaaattaacctgaagggtgtcact

SEQ ID NO: 283118 - DNA, 686 bp, Homo sapiens
aatagaggtgaggtcacaacataggaaagttgcttggtgtataattagtgtggggagcacaggggggtggattacaatgcacagacaaattctaatccatagcctgtaatttgagggttgggtcaatcataatttgggtgcaagcacacctacttccttttttaataagggagaatttagctcttgttacccacaagagttctcaaagtagaaaataataaaccatgttcttgaagccagtactgaattatcaaagctgaaggaagggaagctaaagaaagattaggcaacttggggtacaaatgcgttcaaaatcctctccgtcagtatgccaagtctctggataccagtgacttatttgccctggggtgagagaaaactccattttccatcaagctggagaagcagcctttgtttttcagccatggataaggccacttattaggaggacaacaagaaggtggaccagtaagacaacatgacacgtaaggcaggagaatcacttgaacctggaaggcggagattgcagtgaactgagatcacaccaatgcactctagcctgggcaacagagtgagactctgtctcaaaaaagaaaaaaaacaaagacaatacgacatacctagattctaattcaacacagaaaatgcaaaacaaataaataaataaataaaataaacataaaacc

SEQ ID NO: 283119 - DNA, 292 bp, Homo sapiens
aatagcacttgacttggcaaattttcttagctccctgtttccccagagccccaagcttacatgtcagatgcccaccaaggcttcacagctcattacttcccttcctccctgtttccttagtgaaatctcaggaggatgcttaccaggaatcaggaaactggaaaaacaatggcctgctgggacagatctccaagccctagaggaccacaggtgaatgtcacctgtaagtctccgctcattctagccaatgtaattctacaaaaggccacatctaaactactgaaatgcatgc

SEQ ID NO: 283120 - DNA, 565 bp, Homo sapiens
tgccaggctaagaaaccaggatattttattttctgataaaaagaggatgcttttttggcaaatttctgcttcggagtgaagatgctgcacttgtttccttgttttgtgacatcattgcaatctcttgatttttttcatccctcggattccttagcatccttcaaaagtaatgttcctgcagtctcgcagaaggccgaaggatggagaatttctagtccaggccagggacactcagaagagagaaaaaaaaaagaacaaaaaaagacccaagcagcttcacagggcctcatctggtccaatttcttctcatgatgcattcattcactcataaatatcttttgagcacctactatgtgttgggtagatctagggataaaatcagggttaaaaatacagtcgctggtctcacagcaaaaaaggcacctgaggcccagagagggccactgacttgccaaaagtcacaagctaaaacttctgtggccgaaccgcgtctcgaacacaactggcggaggcccacggcgcctgcagcccagctgcagaatgctacaaagcaacgggggccggt

SEQ ID NO: 283121 - DNA, 447 bp, Homo sapiens
tgccaggctaagaaaccaggatattttattttctgataaaaagaggatgcttttttggcaaatttctgcttcggagtgaagatgctgcacttgtttccttgttttgtgacatcattgcaatctcttgatttttttcatccctcggattccttagcatccttcaaaagtaatgttcctgcagtctcgcagaaggccgaaggatggagaatttctagtccaggccagggacacttatgtgttgggtagatctagggataaaatcagggttaaaaatacagtcgctggtctcacagcaaaaaaggcacctgaggcccagagagggccactgacttgccaaaagtcacaagctaaaacttctgtggccgaaccgcgtctcgaacacaactggcggaggcccacggcgcctgcagcccagctgcagaatgctacaaagcaacgggggccggt

SEQ ID NO: 283122 - DNA, 541 bp, Homo sapiens
tgccaggctaagaaaccaggatattttattttctgataaaaagaggatgcttttttggcaaatttctgcttcggagtgaagatgctgcactagatgggaaggagaagaggagaaatggaaagaagaaaagcatccttcaaaagtaatgttcctgcagtctcgcagaaggccgaaggatggagaatttctagtccaggccagggacactcagaagagagaaaaaaaaaagaacaaaaaaagacccaagcagcttcacagggcctcatctggtccaatttcttctcatgatgcattcattcactcataaatatcttttgagcacctactatgtgttgggtagatctagggataaaatcagggttaaaaatacagtcgctggtctcacagcaaaaaaggcacctgaggcccagagagggccactgacttgccaaaagtcacaagctaaaacttctgtggccgaaccgcgtctcgaacacaactggcggaggcccacggcgcctgcagcccagctgcagaatgctacaaagcaacgggggccggt

SEQ ID NO: 283123 - DNA, 321 bp, Homo sapiens
gaggatgcttttttggcaaatttctgcttcggagtgaagatgctgcactagatgggaaggagaagaggagaaatggaaagaagaaaaggtgagttccaaggacagaaacactccctctttggactccccccaatttcatggactctctcccgcaaaaaaacacacaagaacttcctgccttgtttccttgttttgtgacatcattgcaatctcttgatttttttcatccctcggattccttagcatccttcaaaagtaatgttcctgcagtctcgcagaaggccgaaggatggagaatttctagtccaggccagggacact

SEQ ID NO: 283124 - DNA, 522 bp, Homo sapiens
ctctcagatctaactccagtccaatatcccctaagaagccttctctgaccactccagggcacaatgatctcaaggttcagcatctccagagatgagctttccaaatacctgatgaagatatgcatgtgagaaggaattaatgacaggcattaacactatattggccagaggactcattagctgattccgcaggatatgtggataccaaaattacctcagggccatttgctgtaatgaactgccgctggggagagacatcataaggtctgagatggtctgcagcaagcggtgaaaggagtcagtgatgccacaaaatgccacagaatatcatggagagaagtggtttggatgacattacacagaagccagttgaaagcctgaagaaatgacggttaaatgagttcaagaataaaatacatgagtttaaaaagtactcagaaataaagtacctccatggattaagacttcaaagaaagatactagaaaatcttttttaattaaaaaaaatgccttatagtttta

SEQ ID NO: 283125 - DNA, 352 bp, Homo sapiens
ctctcagatctaactccagtccaatatcccctaagaagccttctctgaccactccagggcacaatgatctcaaggttcagcatctccagagatgagctttccaaatacctgatgaagatatgcatgagtcagtgatgccacaaaatgccacagaatatcatggagagaagtggtttggatgacattacacagaagccagttgaaagcctgaagaaatgacggttaaatgagttcaagaataaaatacatgagtttaaaaagtactcagaaataaagtacctccatggattaagacttcaaagaaagatactagaaaatcttttttaattaaaaaaaatgccttatagtttta

SEQ ID NO: 283126 - DNA, 395 bp, Homo sapiens
ctctcagatctaactccagtccaatatcccctaagaagccttctctgaccactccagggcacaatgatctcaaggttcagcatctccagagatgagctttccaaatacctgatgaagatatgcatgtgagaaggaattaatgacaggcattaacactatattggccagaggactcattagctgattccgcaggagtcagtgatgccacaaaatgccacagaatatcatggagagaagtggtttggatgacattacacagaagccagttgaaagcctgaagaaatgacggttaaatgagttcaagaataaaatacatgagtttaaaaagtactcagaaataaaggcgcagcggccgatggaattttgtaagaagatatgtgtgtgcacgggggggt

SEQ ID NO: 283127 - DNA, 476 bp, Homo sapiens
aaaggtgagtcctgcctggactgggtttgctcggtttccttgcagccccacatgggagttcactctgtgggtgatgagttttccccaacctctgcctctccaaaagaacttctaatttccctttcccaaagatctgcaggatagtggttggctagtatttgtgagtggctcagaagggagttcatcatagtctttgtgttcaaagaatgttctaagaactagtacattaactagctttggggcctcagttgaacctcagcttccttaactgtaaaatggagctattttacctattgtgagagtctacaattatttggtgttacaccgtcttcactgcgtaactttactccacaaacaaaaaggaattggtgccaaaatagcactcagaacaggttctgcagcctgttaagcagttccttcaaatattagagcttcctgagttaagcaaagggtttgctttgaatcccctcaccttg

SEQ ID NO: 283128 - DNA, 587 bp, Homo sapiens
taggctgtggcttactcttggggcctccctgcaaactccatcttctgatttgcgctgggagtgactcctccttccatcctacagcctggggtgctgctgctgctactctggggaccgggaggaggcacacggccacagggacgtttgttcgtgattttgcaggaaagcacatggccctcgggagccaggtaaatgtgttcaagctggtcctttcccatttctcaccttgctccctctcccggtttccctgggaaatcattttcactgtagctggggctcactagcgattaggaactagctttccttctttgaaagcagcacatgaaggtgagcaggcccagagcctgtgccccagtgggctagaacacgtgcaagacagggcctcacaccgtcctttctcttgtatttgatccctttggtctgacgttttcaaggacaaggattcctctggattctaccctaaagatggatgccacaggctccaccaaagtgcagtccaaaagcagaatcttcagagaggaacgctaggagactttatctctcagcagtgcctctttccagagttcgctggacaggtaccgagctgt

SEQ ID NO: 283129 - DNA, 609 bp, Homo sapiens
taggctgtggcttactcttggggcctccctgcaaactccatcttctgatttgcgctgggagtgactcctccttccatcctacagcctggggtgctgctgctgctactctggggaccgggaggaggcacacggccacagggacgtttgttcgtgattttgcaggaaagcacatggccctcgggagccagcgttcctctctgaagattctgcttttggcctgcactttggtggagcctgtggcatccatctttagggtagaatccagaggaatccttgtccttgaaaacgtcagaccaaagggatcaaatacaagagaaaaatgttgccaaactcacaatggccatgatggcattgagaatttacattctctcaagcctaaagaaggtgtcaaatggcagtggatttcagctttgctgggctgtgccctggtttaagctttgcacactggcccagggaagtcccacactaaagcccacagatgcgaataaattactgacagtgcccaacctcccctgccaggtggcatggaggtccagatgctgacctggctgaaagagaatactgtgttggcggctcctgatgcagagttaaatgcttgttaaagaaaaa

SEQ ID NO: 283130 - DNA, 1074 bp, Homo sapiens
ggaagggggcgccaggcagcccctgacctcacttggaagaggagagaaagagagtcgaagacgccctgtcaagatgccactcacctaaacgccaggaacatctccccgactaaggacaggccgacccccagcaggaccagcgccacgagcttccccatggtctcggggtgcccagcggcgactgcgcggcgccgagagctctcgggggcgcggcgggcggttcctgcctcgcgtacggattggggcccgctcggccccgcccgcacacgcctcctacttacctgagcggcccgggtgccgcagcagggcgctgacgagtcccgccgagccccgccgcccgggttcaaggccgccttcacgcccacgattccttgttttttgggcagaggtcaaggctcaacggagagggagcccgggaccgagttgtggtgggagtttgctcctaacacccgcgaaatcctacctcaattcctcagatggcctgagggagaaaccggagggcccgggaatggcggggagctccagttcagagccggaactccggacttctgcaaggccagacgtgaggcgacactgaattgctcccgagacgcgggaagggcgaaggcaatcgaagcgaagagctttaactcatcttctccaggatttggggcacgggaacctgtctcctgaccttcgtgccttacctcggagtgtgctgcccagacggacttgtgaatagctgtgtctgtccccatagttaacgggagaaggaaacaccaggagaaaagaaggaaaagacaggaaacgggaagaggagcagaggcgaggaaggggaaggtcatttccttggcagggtaggccctctttcttctaggtcttgagttcctgccaggcaagaaatgctctttcccctctcctgatgaacaccaggttggagggggaggaactgaagatgcgggaagacttggggagttcgggcaaagtagcacattcaagcatgatctatttttatttacggacagaaagaaatattagttctgttaggttccaccgagtaaactatttgttgagagagcaagatttgccaatcct

SEQ ID NO: 283131 - DNA, 1261 bp, Homo sapiens
ggaagggggcgccaggcagcccctgacctcacttggaagaggagagaaagagagtcgaagacgccctgtcaagatgccactcacctaaacgccaggaacatctccccgactaaggacaggccgacccccagcaggaccagcgccacgagcttccccatggtctcggggtgcccagcggcgactgcgcggcgccgagagctctcgggggcgcggcgggcggttcctgcctcgcgtacggattggggcccgctcggccccgcccgcacacgcctcctacttacctgagcggcccgggtgccgcagcagggcgctgacgagtcccgccgagccccgccgcccgggttcaaggccgccttcacgcccacgattccttgttttttgggcagaggtcaaggctcaacggagagggagcccgggaccgagttgtggtgggagtttgctcctaacacccgcgaaatcctacctcaattcctcagatggcctgagggagaaaccggagggcccgggaatggcggggagctccagttcagagccggaactccggacttctgcaaggccagacgtgaggcgacactgaattgctcccgagacgcgggaagggcgaaggcaatcgaagcgaagagctttaactcatcttctccaggatttggggcacgggaacctgtctcctgaccttcgtgccttacctcggagtgtgctgcccagacggacttgtgaatagctgtgtctgtccccatagttaacgggagaaggaaacaccaggagaaaagaaggaaaagacaggaaacgggaagaggagcagaggcgaggaaggggaaggtcatttccttggcaggggtctcgctgtgttgcctaggctggagtacattggcacaatcatagctcactgcagtctggacctcccggactcaagggaccctccagcctcagcctcctgagtagctgggaccgcaggcctggcagctgtggcgactgaatctaagaagaaaggctgataatgctctggctggtttcataataggacttttcaaggcactgtcccatccattaactcatttgaaatgaaagatgaagaaaccgagccacacagaggttaaataacttgcccaagggtgcacaactactagtagtattgagtctatacgcttaagtattgtgctattccatttcttactgaatacaaagcaaaaaaacataaggatcagaggaggagtgtgagtgtcctcatactcacagcaaaaggaggtcagtgggtgtgtgt

SEQ ID NO: 283132 - DNA, 1828 bp, Homo sapiens
aattctgcggccgcaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283133 - DNA, 2124 bp, Homo sapiens
  misc_feature (17)..(17): n is a, c, g, or t
tcaggctggtacccccngggtgttatgggatatcgtcgaccacggcgctcgggggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283134 - DNA, 2559 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccagaaaaaacaagatcaaacacacaaaaggggggagcccaggtcctaaaaggatatccccataaaaagggccccaaggtataaagggagaacccaaaggtttatcttggttcaccaagggtgtgtccccctaaaggttggagcggaatattaattacgccataggacaagaggacacggcagtttataacaaagcggtgcggataacgtggcaaaagacagtgataaacgtgggaggcaaacgatgggtgaaaaagaaggaaaccctattacttccatggaggatgtggacaccacataatgcttggggaaacaaacatggtaccctacaagatgatttttgaaaggcactcgatagcgtgacagatcattaaagacgtttaacagcgtgtctatagcagtgtgttaaacactacccggcactatgcatgatcggggatgagaaaaatgaggagcagaacgacgaaatcatgatttacgagaagcttttttatcccg

SEQ ID NO: 283135 - DNA, 2210 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccagagccatgcaaagttcttggtggggagggggaaagggcccatgctggcttaggggctctaaggcgcccagactcacaggtgctgtgaagagctcctttattggggtgatggaatcggttccaaagagctggtttactgctgtgaag

SEQ ID NO: 283136 - DNA, 2189 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283137 - DNA, 1851 bp, Homo sapiens
taggagagacctaagtgctggagcttagggatccggcctgggggtggagttcaggtcgtggaagggtggagtctcatagcctggcctgtctaaggcccctgtctatgctattctcatagccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283138 - DNA, 2281 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283139 - DNA, 1926 bp, Homo sapiens
ctttgatgaaggggcgtggctcttagctgctccgagagccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283140 - DNA, 1691 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283141 - DNA, 1428 bp, Homo sapiens
  misc_feature (3)..(3): n is a, c, g, or t
tgntcacagtgggcccctgccaggcctgtcctctcctttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283142 - DNA, 2302 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccagagccatgcaaagttcttggtggggagggggaaagggcccatgctggcttaggggctctaaggcgcccagactcacaggtgctgtgaagagctcctttattggggtgatggaatcggttccaaagagctggtttactgctgtgaag

SEQ ID NO: 283143 - DNA, 1843 bp, Homo sapiens
tttatggtccattcgagaaattttattggttaaatgatgcccagatggggtcacatcctcagaacttctcagcctggtagcacaagtggatgcttgaagaaactcagtcttggaactcagacagcaatggagacgggatgtgagtgggaccagcaaggggctaaggtccattatgagggtgaggaagggcttctagaagtaacaaacatcccaggtccctgactggggagaatgaagacactgaccaagagatgtgaagccactcagggctgtgcagggtctgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggagggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283144 - DNA, 1733 bp, Homo sapiens
aattcggcactaggggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283145 - DNA, 1284 bp, Homo sapiens
cttgcctgactgagcagggaggcactcagacaccatcacacatctggcacacaggcttttcaacactgaggagcagccctgcctaagctgcgggctggtggagtgggtcaggcccagccagggaagaacactcatcacctagcagcctggggcatagcacgaacagtgaagctcctggttgaccctgaaccactggccaggctcaaggcgggatacccagagtggtgacaagccttttctcttgcagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283146 - DNA, 1618 bp, Homo sapiens
tttatggtccattcgagaaattttattggttaaatgatgcccagatggggtcacatcctcagaacttctcagcctggtagcacaagtggatgcttgaagaaactcagtcttggaactcagacagcaatggagacgggatgtgagtgggaccagcaaggggctaaggtccattatgagggtgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggagggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283147 - DNA, 1468 bp, Homo sapiens
tttatggtccattcgagaaattttattggttaaatgatgcccagatggggtcacatcctcagaacttctcagcctggtagcacaagtggatgcttgaagaaactcagttcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggagggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283148 - DNA, 1241 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagctctgatggaataccgtcagcaccacgcatgactggcagcctggtgtctgatcgaagccacgacgacatcgtcacccggatgaagaacattgagtgcattgagctgggccggcac

SEQ ID NO: 283149 - DNA, 1036 bp, Homo sapiens
tttatggtccattcgagaaattttattggttaaatgatgcccagatggggtcacatcctcagaacttctcagcctggtagcacaagtggatgcttgaagaaactcagtcttggaactcagacagcaatggagatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283150 - DNA, 788 bp, Homo sapiens
tttatggtccattcgagaaattttattggttaaatgatgcccagatggggtcacatcctcagaacttctcagcctggtagcacaagaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283151 - DNA, 1818 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagtggctgaggggatttcttgcagtggtgttctgaagagtaggcatggatgcacaaaggtggtctttgtgaaaggcagagatcattctggttgggaggcagaaaagggaggatgagggaaggctcgtacatgggacagagcttaggtgatgaagatgctgtgttaaccaccattttgtaattattaatgtggacctgggcatccaagtggcagtacccagcagcaggcggttaaa

SEQ ID NO: 283152 - DNA, 1285 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283153 - DNA, 806 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283154 - DNA, 571 bp, Homo sapiens
atcctttagggtttcaggttttttatctggaaattggggatcatggtacctcccccttagggttgctgttaggcttgaaggaaacctgtcaaagggctgtgagctgtggtgtcctgctgagctgtctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaa

SEQ ID NO: 283155 - DNA, 378 bp, Homo sapiens
ccctgtcctgagccagatcccttccctgacactcacctgtcccccttctccaggagaaagaatcaacggaagactacaatgtggcctgcatcctaaccctgcctccctaccagcgccggggctacggcaagctgctgatcgagttcagtgagtatgtgtgctgcggccagggggtagtggacccactatcggtgcctcacaggcagatgggccaggctactgtgattctcaaccctggctgtgcagcccagcctctaggggaaccagccagaaataacagtggcactctcccggggttctctccgttcaggctgactgccctgcttatctggggtaggttctcagccccccagtttgctccttggccagggttctaag

SEQ ID NO: 283156 - DNA, 2222 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283157 - DNA, 2339 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283158 - DNA, 2066 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283159 - DNA, 1946 bp, Homo sapiens
gcaggctggtacggccccaagtcgtattgagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283160 - DNA, 1830 bp, Homo sapiens
aattcggcactaggggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283161 - DNA, 2015 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttctggcttctcttacccctattgcccccggcaataaattgtttctatatgccaga

SEQ ID NO: 283162 - DNA, 2158 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283163 - DNA, 1790 bp, Homo sapiens
  misc_feature (21)..(21): n is a, c, g, or t
gctagtgagccccgggcttantcggacgagggcggaaccaggacatgaagatgagtggccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283164 - DNA, 1762 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggtgggtgctggctgcaaaaatttctggcttctcttacccctattgcccccggcaataaattgtttctatatgccaga

SEQ ID NO: 283165 - DNA, 1720 bp, Homo sapiens
tttatggtccattcgagaaattttattggttaaatgatgcccagatggggtcacatcctcagaacttctcagcctggtagcacaagtggatgcttgaagaaactcagtcttggaactcagacagcaatggagacgggatgtgagtgggaccagcaaggggctaaggtccattatgagggtgaggaagggcttctagaagtaacaaacatcccaggtccctgactggggagaatgaagacactgaccaagagatgtgaagccactcagggctgtgcagggtctgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggagggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283166 - DNA, 1699 bp, Homo sapiens
caagtgtgacctacgacatcctccaggcaatgagatttaccgctgggccggcaccgcctcaagccgtggtacttctccccgtacccacaggaactcaccacatgcctgtcctctacctgtgcgagttctgcctcaagtacccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283167 - DNA, 1439 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaga

SEQ ID NO: 283168 - DNA, 1296 bp, Homo sapiens
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagtgagtatgtgtgctgcggccagggggtagtg

SEQ ID NO: 283169 - DNA, 1354 bp, Homo sapiens
  misc_feature (1155)..(1155): n is a, c, g, or t
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcccatctctncttgggatgaggcgtagaaccagagtttcccagaactggtttgggcaggttcctgacctagcactgttaagaacaaacattcctttaagagaaaagaagcgggccccgggcttccgagaacaacggacacggggccccgcccaccggcaggcgttacacggaggcacaccccaaccacctgggcaagcccaccaccggg

SEQ ID NO: 283170 - DNA, 1471 bp, Homo sapiens
  misc_feature (1272)..(1272): n is a, c, g, or t
agctcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcccatctctncttgggatgaggcgtagaaccagagtttcccagaactggtttgggcaggttcctgacctagcactgttaagaacaaacattcctttaagagaaaagaagcgggccccgggcttccgagaacaacggacacggggccccgcccaccggcaggcgttacacggaggcacaccccaaccacctgggcaagcccaccaccggg

SEQ ID NO: 283171 - DNA, 2444 bp, Homo sapiens
  misc_feature (1926)..(1926): n is a, c, g, or t
  misc_feature (1931)..(1932): n is a, c, g, or t
  misc_feature (1937)..(1937): n is a, c, g, or t
  misc_feature (1942)..(1943): n is a, c, g, or t
  misc_feature (1946)..(1946): n is a, c, g, or t
  misc_feature (1957)..(1957): n is a, c, g, or t
  misc_feature (1962)..(1962): n is a, c, g, or t
  misc_feature (1974)..(1974): n is a, c, g, or t
  misc_feature (1995)..(1995): n is a, c, g, or t
  misc_feature (2025)..(2025): n is a, c, g, or t
  misc_feature (2030)..(2030): n is a, c, g, or t
  misc_feature (2080)..(2080): n is a, c, g, or t
  misc_feature (2104)..(2104): n is a, c, g, or t
  misc_feature (2112)..(2112): n is a, c, g, or t
  misc_feature (2160)..(2160): n is a, c, g, or t
  misc_feature (2168)..(2168): n is a, c, g, or t
  misc_feature (2170)..(2170): n is a, c, g, or t
  misc_feature (2180)..(2181): n is a, c, g, or t
  misc_feature (2185)..(2188): n is a, c, g, or t
  misc_feature (2203)..(2203): n is a, c, g, or t
  misc_feature (2264)..(2264): n is a, c, g, or t
  misc_feature (2266)..(2266): n is a, c, g, or t
  misc_feature (2268)..(2270): n is a, c, g, or t
  misc_feature (2289)..(2289): n is a, c, g, or t
  misc_feature (2310)..(2310): n is a, c, g, or t
  misc_feature (2313)..(2313): n is a, c, g, or t
  misc_feature (2317)..(2319): n is a, c, g, or t
  misc_feature (2322)..(2322): n is a, c, g, or t
  misc_feature (2325)..(2325): n is a, c, g, or t
  misc_feature (2431)..(2431): n is a, c, g, or t
gaaaattgtactgtgaggaccttgacagcttcacaggcgggctttttcttttgcctccctatatgcgctagaatatctatttttctcttttacaaactgactatataaaaccacctcttctggcattgcagaaagcaattgactttctcagagccacccggcaggctatcggggcatcctcgaaaaggccagggacaggggcgcaggtgcaccaagagatctggcgaggggtacgcttcctcgagacttggggctctttctctctgcgctctccagacactgaactctgagctgcaaggacaagaacgccaccaccttccctactaaggctctgccacaagcgcatcccagtgaggtgtatccagctgcagccgcctccggagcttcggagcgctcagacctccctccctcgcgcatctccagcctaagggttgtcccacctcgccataacacggggctctcgcgcgggcatcgaggattctcagcttttggcgtcccagtcctgcctctgctcctgcctggtggtgtccccacgcccaggtcctgcggacccgaccacggctgaaacgcgcggctttgccgtctgcgctccagccttcgcctggcagagcgcgcagcccacctagcgtcttctggctctaggggtgcagagggcgcatcccgcctcttcctccgcccccgggccccgctgtcctcccccacctgctgaccagcctactcctgcgtgagctgccagccttttgccttctgtgcgtaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgcattcgggctcctcgcacctacnccaannaacanaaaannacnaccaacagaanaccangcaaaccagaancaaaaaacaaaatttcaagcnaaatgcaaagaatcaagtaaaaaaagccancaaanatcaaaatagtaaaaaagtataggccaagaagaagaaagacaagaaaagnagagaaaaaatgtgaagaaaaaanaaaagtcnaaaaggctagaaaaatcaaaaatgcaacaaaaaaggctaaaaatcagnaaaaaaancnagaacgggannaagnnnnaaggtcctgccctancctctcccaagagcaccagcagcaggtcttgggagccattgagagggccaagcaggtaaangntnnngagctgaactctatcatcngacagcagctccaagcccaanagntgtnnnagntgnaggccctggccctgcccttgacccactacccgtggggctgcagccgccttcgctgccggcggtcagcgcaggcaccggcctcctctcgctgtccgcgctgggttcncaggcccacctca

SEQ ID NO: 283172 - DNA, 4125 bp, Homo sapiens
gaaaattgtactgtgaggaccttgacagcttcacaggcgggctttttcttttgcctccctatatgcgctagaatatctatttttctcttttacaaactgactatataaaaccacctcttctggcattgcagaaagcaattgactttctcagagccacccggcaggctatcggggcatcctcgaaaaggccagggacaggggcgcaggtgcaccaagagatctggcgaggggtacgcttcctcgagacttggggctctttctctctgcgctctccagacactgaactctgagctgcaaggacaagaacgccaccaccttccctactaaggctctgccacaagcgcatcccagtgaggtgtatccagctgcagccgcctccggagcttcggagcgctcagacctccctccctcgcgcatctccagcctaagggttgtcccacctcgccataacacggggctctcgcgcgggcatcgaggattctcagcttttggcgtcccagtcctgcctctgctcctgcctggtggtgtccccacgcccaggtcctgcggacccgaccacggctgaaacgcgcggctttgccgtctgcgctccagccttcgcctggcagagcgcgcagcccacctagcgtcttctggctctaggggtgcagagggcgcatcccgcctcttcctccgcccccgggccccgctgtcctcccccacctgctgaccagcctactcctgcgtgagctgccagccttttgccttctgtgcgtaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttgacttattgatattttacttggaaagattttacttgctggagtggttatttttatattgaatggcaagaatgagaacttccagagatgaaaactcttcaagaacaaggatctctgtagcgttacctactgatgttgaaagagttagtagatcaaacagaatagtaggaaacaagaaaacattaaacttatacaggaaaaatgtctggccatatgttagttagttcgggaatggttattggtaatttgttttgtattatagcatacaataactagagttaccaaaggcttgttttttcttgagcagttgaaaggagagaccaatatttgtgacatggatagtttcatgaccacaactcattcaatcattttatagtctatggcaatatccaagagattgccaagagtagaagacagaatatttcatctgacagtatctgattggtttactgtttttctaatcatatgtggtcataacgggaagcagaattatgctttattcaaacaaacctgcttctgcctcattttcctaagctatgagaacaattagagaaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgttacattgatctgtacattattttaagccacatgtttgtaattgtttaaaacaaagtggaaacattacacaatgtccttaataaataggcccatgtaaattttaattacaattaataaatgatcaaaaaatttgcatttaaaaaaaaaa

SEQ ID NO: 283173 - DNA, 445 bp, Homo sapiens
gtacaatatcagttatgaaaaatcaagaatttctaatctcccaaggacaaacgcaaaagttgtcaagtatttgttaaaacagcttctacaaagtggaagataatagagctggatgcttatgaatcacacacaggtccccgctggaacccaggggctgaatgggggtctgatctcaactcacctgtacagattctgccaagacaaacagtgagcctgtcacggcccctgtcacagccaggcatatgcaacttgacaacagattacatcagtgaatccacacctgtcaaagttctcagatggccagatcgcactggctaccgtgggtagtcacagtgttgtgacagacacattctaaaggagtgctggaaggccatgggagaaggtacgcatggctagcactatagggcaccgctgcttcctaccaaatcccccggaagggattggg

SEQ ID NO: 283174 - DNA, 1350 bp, Homo sapiens
cagcggcggcgcggcgggcggagccgggaggcggggaagcagtggccgtgtgagcgtgaggagctgccgccaccgcctgctcctcgtcgtcctcgtcctccggggccccggcgacgtgggccgcgcacggccctggaaaagacgtcgcctccccttcatccgcctctctctcaccgcgccgctcccgcctcctcgtcctgcgctgcgggctcaggcggaacccggaacggccgtcctcttcccccgccctccgccgcctcctccttctcctcctcctcctcctcctcctccttctcggcttcctcctcagccccgggccggagcggggtgtcggcggcggccggttcgggcggcgactcgcgcttctttgggcggcggcgcttggccatgtcgtgtcggggaaggtaatgagccgcagagccccggggtctcggctgagcagcggcggcggcggcggcggcaccaagtatccgcggagctggaatgactggcaacccagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaag

SEQ ID NO: 283175 - DNA, 1332 bp, Homo sapiens
cagcggcggcgcggcgggcggagccgggaggcggggaagcagtggccgtgtgagcgtgaggagctgccgccaccgcctgctcctcgtcgtcctcgtcctccggggccccggcgacgtgggccgcgcacggccctggaaaagacgtcgcctccccttcatccgcctctctctcaccgcgccgctcccgcctcctcgtcctgcgctgcgggctcaggcggaacccggaacggccgtcctcttcccccgccctccgccgcctcctcctcctcctccttctcggcttcctcctcagccccgggccggagcggggtgtcggcggcggccggttcgggcggcgactcgcgcttctttgggcggcggcgcttggccatgtcgtgtcggggaaggtaatgagccgcagagccccggggtctcggctgagcagcggcggcggcggcggcggcaccaagtatccgcggagctggaatgactggcaacccagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaag

SEQ ID NO: 283176 - DNA, 1059 bp, Homo sapiens
ttaacagtcatgggtcggtgtcccgtaggctggtaatgactggcaagccatgaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaag

SEQ ID NO: 283177 - DNA, 382 bp, Homo sapiens
gctcatctgcaaaagatgaagttaaactcctctacttatgtgccacctacaaagcactagagactgtaggagaaaagaaagccttttcatctgtaatgcaggtaagaatgaagggggaaaaatgcatgatgtacttgggaagaaaattgtcccttaacacatgtccttggaggggagcttgaagaagggaaacatagaataggggttatctactgataggaaatatgttttaaaaattcctctttctcagtttgagtaaaggatacactgttcaaggatcagtgctacatacatatatgcatatatgtggagaaagagggagagatttcttctaagaaattggcttacacgccaggtgcggtggctcacgcctgtaatccca

SEQ ID NO: 283178 - DNA, 1466 bp, Homo sapiens
cagcggcggcgcggcgggcggagccgggaggcggggaagcagtggccgtgtgagcgtgaggagctgccgccaccgcctgctcctcgtcgtcctcgtcctccggggccccggcgacgtgggccgcgcacggccctggaaaagacgtcgcctccccttcatccgcctctctctcaccgcgccgctcccgcctcctcgtcctgcgctgcgggctcaggcggaacccggaacggccgtcctcttcccccgccctccgccgcctcctcctcctcctccttctcggcttcctcctcagccccgggccggagcggggtgtcggcggcggccggttcgggcggcggcgcttggccatgtcgtgtcggggaaggtaatgagccgcagagccccggggtctcggctgagcagcggcggcggcggcggcggcaccaagtatccgcggagctggaatgactggcaacccagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaag

SEQ ID NO: 283179 - DNA, 1228 bp, Homo sapiens
agagatggggacggaggccacagagcaggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctgcccctcagggcctcaaccccgccgcggctgcccccgccggccccgcctttcttcctgctcagctcccacggagacccacagtctctcctgggacaactagggctgcgaatctagaggagggggcaggctgagggtcgtgggaaaggggagtaggtgggggaacactgagaaagaggcagggacctaaagggactacctctgtgccttgccacattaaattgataacatggaaatg

SEQ ID NO: 283180 - DNA, 1302 bp, Homo sapiens
agcctggcgaatcgcggcgcagtaaggagactgtagtaggaggaggcgcccagggagcgtgcatacaggggacccaccagctcctcgtcgcagccgtctagggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctgcccctcagggcctcaaccccgccgcggctgcccccgccggccccgcctttcttcctgctcagctcccacggagacccacagtctctcctgggacaactagggctgcgaatctagaggagggggcaggctgagggtcgtgggaaaggggagtaggtgggggaacactgagaaagaggcagggacctaaagggactacctctgtgccttgccacattaaattgataacatggaaatg

SEQ ID NO: 283181 - DNA, 951 bp, Homo sapiens
cgtggtcgacggcccgggctggtctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283182 - DNA, 1630 bp, Homo sapiens
gagaaaaaaagcctgtcgcccaggctggagtgcagtggcgtgatctcggctcactgcgacctctccctcccgggttcaaacgattcttctgcctcagcctcccgagtaactgggactataggcacgtgccactatgcccagctaatttttgtgttttgagtagagacagggtttcaccatgttggccaggatggtctcgatctcctgaccttgtgatgtaactagtatttcttatgcccttattttgtgctaggcacagggcctcacccattattggcactcggtaaggattcgtgggattaatgagaagttaacctaaatcttcaccaaaggcccctgagcttcccctcgattcacatacaagggactggggctctgagaggtgggctgtgatgcgcccctggaagacccacgagtgggcctgcagagctgatggggagggttcaggcagggcaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcaaaaaaaaaacaacacaaaaaaccccatcataccaaaaacaaaaacaccaacaccaaacacacaaaacagggggggggggccgaaaaaatcccccggggggggccacattttgcgtcccccactatctgtgcacaagagggccccccaagagaggacgcgctaaacaacacgcacgcgcgccggccgcggaacacaccgcgcgaggggggggaacacgccgacgcaggggagaccccgggaagagaacgaacccccacgcggcggcggggggggacaccatgtgggctgcagaccactccacaacagagaaataagacgccccgcgggagcaacaacaagccgcgcggggaacgcggcgcgtcacacgcgccgcatagtagcgcgcgacaacaacgtcgctcgcacgtatgcgaaaaatgcc

SEQ ID NO: 283183 - DNA, 776 bp, Homo sapiens
ccatacagaagcaccagccagagctgggcatagacggagaagaagagcagggcatacagggtggtgtaggcagctgtcagccccagggtcacagcaggtggcagcgcaggcaccagcccggcagcaggcaccaggccagacaggttactctccatgtcagggagggaggccatcgctcccggccctttgattctcgaattgcggtctcatcttctgggtgctaggtctccagctctggcctttccatttagggccctaggcatcctctcttcccgtctccggcacggagttcctgggatctaaccagttcccattcctgggggcccatgcgtcctcgcgagcgtccctgaccgcccggcgtggagcctcctgggagttgtggccttcattatctcccccccgatctcacttagaggaaggctcacggaagtggagagcctggctcgagctgccatggtaatctaactcatgtaacccttttctccctccaccagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaggactcagcatcaccatcccgtggtgctgtccgcagctaccgggctcggcaggcgtgcgcg

SEQ ID NO: 283184 - DNA, 1412 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283185 - DNA, 1208 bp, Homo sapiens
gagaaaaaaagcctgtcgcccaggctggagtgcagtggcgtgatctcggctcactgcgacctctccctcccgggttcaaacgattcttctgcctcagcctcccgagtaactgggactataggcacgtgccactatgcccagctaatttttgtgttttgagtagagacagggtttcaccatgttggccaggatggtctcgatctcctgaccttgtgatgtaactagtatttcttatgcccttattttgtgctaggcacagggcctcacccattattggcactcggtaaggattcgtgggattaatgagaagttaacctaaatcttcaccaaaggcccctgagcttcccctcgattcacatacaagggactggggctctgagaggtgggctgtgatgcgcccctggaagacccacgagtgggcctgcagagctgatggggagggttcaggcagggcaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283186 - DNA, 1283 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcaaaaaaaaaacaattaacaaacaaaaaagcgcggtaaatacccagggaaacactttgaggacatatataaacacgcgcccaacacgaaggtcgactggggaccaaccaaatatattgtgatacaa

SEQ ID NO: 283187 - DNA, 1001 bp, Homo sapiens
ccatacagaagcaccagccagagctgggcatagacggagaagaagagcagggcatacagggtggtgtaggcagctgtcagccccagggtcacagcaggtggcagcgcaggcaccagcccggcagcaggcaccaggccagacaggttactctccatgtcagggagggaggccatcgctcccggccctttgattctcgaattgcggtctcatcttctgggtgctaggtctccagctctggcctttccatttagggccctaggcatcctctcttcccgtctccggcacggagttcctgggatctaaccagttcccattcctgggggcccatgcgtcctcgcgagcgtccctgaccgcccggcgtggagcctcctgggagttgtggccttcattatctcccccccgatctcacttagaggaaggctcacggaagtggagagcctggctcgagctgccatggtaatctaactcatgtaacccttttctccctccaccagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283188 - DNA, 1439 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggtttcgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgaca

SEQ ID NO: 283189 - DNA, 1693 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggtttcgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgaca

SEQ ID NO: 283190 - DNA, 447 bp, Homo sapiens
ctgcccacgaagtgggaacgggtggagtttcgggatgtggagcgaaggtcactgggagggggcggagcttcccctgcccaagttccgatcccaccaggactggaagactcgcgtccagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283191 - DNA, 973 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacgctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283192 - DNA, 1158 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283193 - DNA, 1580 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcaaaaaaaaaacaacacaaaaaaccccatcataccaaaaacaaaaacaccaacaccaaacacacaaaacagggggggggggccgaaaaaatcccccggggggggccacattttgcgtcccccactatctgtgcacaagagggccccccaagagaggacgcgctaaacaacacgcacgcgcgccggccgcggaacacaccgcgcgaggggggggaacacgccgacgcaggggagaccccgggaagagaacgaacccccacgcggcggcggggggggacaccatgtgggctgcagaccactccacaacagagaaataagacgccccgcgggagcaacaacaagccgcgcggggaacgcggcgcgtcacacgcgccgcatagtagcgcgcgacaacaacgtcgctcgcacgtatgcgaaaaatgcc

SEQ ID NO: 283194 - DNA, 838 bp, Homo sapiens
gaggacacaggctaagagagtcgaaggctggctagacaaggggagagacacagagctccgctgatcatcactggactctggattccaccaaacctttggaaccttccagcctcaggcctccacagcttcacagaaactgggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283195 - DNA, 740 bp, Homo sapiens
gctgactcagaagcccaacacgcagagaatgtaaagctagaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283196 - DNA, 1094 bp, Homo sapiens
cgcatggtgtgtgtgtgtgtgtgtctcacagggcatgctgggatctgtagtctagatcccactccaggccaaagctcctgggttccccgaattcttggaagaccaggcatgctggtatttgtgctccttgctggcacctgtgcgctctgtcgcccaggctggagtgcagtggtgcgatcacggctcactgcagcctggaactcctggcctcaaaggatcctcccgcttcaacctcccaaagtgctgggattacaggcgctcaccatcgctcccggccctttgattctcgaattgcggtctcatcttctgggtgctaggtctccagctctggcctttccatttagggccctaggcatcctctcttcccgtctccggcacggagttcctgggatctaaccagttcccattcctgggggcccatgcgtcctcgcgagcgtccctgaccgcccggcgtggagcctcctgggagttgtggccttcattatctcccccccgatctcacttagaggaaggctcacggaagtggagagcctggctcgagctgccatggtaatctaactcatgtaacccttttctccctccaccagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283197 - DNA, 1214 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactcattgaggttcgttatactgcccaggctggtctcaaactcatgacctcaagcaatcctcccaccttggcctcccaaattgctgggattacaggtgtatttacagtggttccttagcctaagatctatgcttaactgtgataacattttatatactat

SEQ ID NO: 283198 - DNA, 459 bp, Homo sapiens
tagtacctacatattccggaactacatacctcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgc

SEQ ID NO: 283199 - DNA, 1046 bp, Homo sapiens
tgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccaccttaggagtctgacctctcacttttccagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaaggtgagcgccagtccccagcgtgccaggacctgaagtaccaggccgccccccgccggtctgtccctgccttgtcccaaggcacgcccggatctggagtcccacgacccctccccaaagccgtcctgttccttcctagctcca

SEQ ID NO: 283200 - DNA, 943 bp, Homo sapiens
tcacaagccctctttcctggactaggaggaagaactcaatgcctctcagctccaggccttactaagcattgccctggagcctggccatattcaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccctctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 283201 - DNA, 642 bp, Homo sapiens
gcccagggctccacggtccctacctagaccccacgcgattcctcacctgagaccccgtcccacacagccccagctggggcaaacagccccctccccacttcccatctgtaatttgcagggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctggtgagttggctgggataggggcaggaggaggggtcttagccaggggtcctgcaaccagagccggtgccaccctatgtctatgaacccaccgcgctgctgggagttgggctcaggaagccagggctcagcctggcagcatctccctgcaggggatcttgtgtgggccccgtgacctgggccacggctgctcgcaagctccccttccgctgaaaggcaaggctgccttgagcacagactgggcaccccctgcctggatttgaatcccagctctgctaggcgcagcagtcactggctccctgtgcctcggcttctataatatgggactgacaacatcacctgcttaagggagtcacatccacccag

SEQ ID NO: 283202 - DNA, 376 bp, Homo sapiens
ggccaacacttataccccgtgaatcaattcttcttcagcatgccagttgctggagacagcaccatttacatacaggcatctatagcagttatcttccaggatggaagcaagagttttgtaatcataaaaaacaggacagagaaacaaggagttctgaaaagaagagaaggcggttatagaggtgttggggataacgttatacacagcatgggcaaagcctggccttacaccacttccagcagctctggggctacctcctggagtggcaggtgaggtgggagactgggcctcttcccagaaagagagaaacctttactaacagagacataggcaccctgtgggctatcaggtccccagggaacgagggggtactgga

SEQ ID NO: 283203 - DNA, 1279 bp, Homo sapiens
gcccagggctccacggtccctacctagaccccacgcgattcctcacctgagaccccgtcccacacagccccagctggggcaaacagccccctccccacttcccatctgtaatttgcagggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctgccagggcccatacctccacccccagagagatcgggctcaggacctgtgagcagctgctgcagtgtttcgggacacagcatgggcaaagcctggccttacaccacttccagcagctctggggctacctcctggagtggcaggccatattcaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccctctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 283204 - DNA, 1210 bp, Homo sapiens
gcccagggctccacggtccctacctagaccccacgcgattcctcacctgagaccccgtcccacacagccccagctggggcaaacagccccctccccacttcccatctgtaatttgcagggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctgccagggcccatacctccacccccagagagatcgggctcaggacctgtgagcagctgctgcagtgtttcggggccatattcaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccctctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 283205 - DNA, 937 bp, Homo sapiens
ctgtcttgcctgggaggccccattggcagccctcttcagggcatggagggcagccctgactcatccttcctgcccaggccatattcaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccctctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 283206 - DNA, 293 bp, Homo sapiens
ctgtcttgcctgggaggccccattggcagccctcttcagggcatggagggcagccctgactcatccttcctgcccaggccatattcaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgtgagtaccaccccggcatg

SEQ ID NO: 283207 - DNA, 1081 bp, Homo sapiens
gcccagggctccacggtccctacctagaccccacgcgattcctcacctgagaccccgtcccacacagccccagctggggcaaacagccccctccccacttcccatctgtaatttgcagggagatcgacgacgtgatcagcgcagacctgcagtctctccagggcccctacctgcccctggagctggggttggagcagctgtttcaggagctggctggagaggccatattcaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccctctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 283208 - DNA, 1144 bp, Homo sapiens
atatgggattgactatattttttgctgcacagaaatatcctccagtgcccactggcaaggagaaagccccacaggatttaaggagtaacagtacccacacatcgagtcacgtgtcagacgctgtcctgagcgttctgtcttcacacaccctatggggtcggggctgtcttagtccgtttgatggatgaggaaacaggcccagaggattgaagggatcagcctgtactcaccctgccgggatggggcagagttggggtgtgacaccctgtggcattcatgtcctccctgaggaggtggggtggggatgcaatgccaaggtgggttccctgtgggccactgggctcagaagcagcctccccctaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccctctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 283209 - DNA, 395 bp, Homo sapiens
aaaggcatataaaaattcttgtgccctcctttctctctcatttgtcttctgttagattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtaggtctgaaagatgatatgtattcagttgagctagatgtgtaatacatgatgcttccctatcctgaagacactataatactacctataaaataagaaaaagatagcttggttgttgtatcaacttaactgttttg

SEQ ID NO: 283210 - DNA, 795 bp, Homo sapiens
ggagtgaagatgatagtacccctcaaactctacacttgagcaccaagtagagaaaaattagtgaaaaattagtactgtcatcttggagcctgtgtgtaggacctacctcataatttggcccagtgcaaagagaaatgcaaacccccttgttcaaaagtttgaagacagcaagagtggagcaatcagtcaaaatcaatggtggtggtggggacaaatgaacaagtcccactcccaagaagccagcctgcctgtgtgtgtgggagaaagaacctcatctcagaatcccaagacttgttgctagggtgcgtgatgctctaaaaggtccaagaagagcatagaggagctctctaaggagagcttcttgagcgaaagtgtgcatgttatggtgccatccctaactttagagatgatggtcataggatgagcagggccctcccctggccaggatgggatccgtcaggaagactgtttatatccttaggttgaggattattcatcccctttgacggatgagaaaactgagacttcaagaggttcaatgctgagagtcacactgctagtgaatggtggaatgcgagcccccctatccaagaatctctagaggcaagcattgcctggaggtgagtcatctgcttggatggctattgaagctctgaagaaagtggccacttctggggctggtgttaacacctttaaaggaacatggcagctgcaggtttgtgactgatggagaggcactgataacaccttcttatccaaaaccttctccctcatcaaactggcacttctgcctga

SEQ ID NO: 283211 - DNA, 2592 bp, Homo sapiens
gcgatcccttgctgcgggcccggagatcaaacgtggcccgcccccggcagggcacagcgcgctgggcaaccgcgatccggcgccggactggaggggtcgatgcgcggcgcgctggggcgcacaggggacggagcccgggtcttgctccccattggccgccacctcggcgggaggggccgcctccggctcgtggcacctggcgtctcccctccgcggggaaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtacccccgcccccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctgtacatcactcaccactactatgacaacgtcaagccgcgtcccggcggccacgccatgccctctgagatcttcaacttcctgcacttgcacagccgaggcatcctccgcgtgcacacgggcacctgcagctgctgctgatggctgccagccaggctgcccggcaagcggcaccccctctcctgctgtccctcctggtggaactgggagccccgaaccccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgacaggttcttctgtgacaccgagagatctaacccaaggcctgggttatgtcttagtcgagacatcatcatctgagaagcaccacatcctttcagacacatcctcggacacacatgcggtcttggtgcccccaggttcaatcctgcgttagctcttttgatgagaaggaaataaaccaaaccagccacttgcactatggcttccaagccaatgttattgactcaataagtgcttagcaattggcttcctcttttgtcttcctattttcagctccatttaaaccaggagttatttataaagacctcttcctctcatgtaaaagaaa

SEQ ID NO: 283212 - DNA, 2110 bp, Homo sapiens
ggagtgaagatgatagtacccctcaaactctacacttgagcaccaagtagagaaaaattagtgaaaaattagtactgtcatcttggagcctgtgtgtaggacctacctcataatttggcccagtgcaaagagaaatgcaaacccccttgttcaaaagtttgaagacagcaagagtggagcaatcagtcaaaatcaatggtggtggtggggacaaatgaacaagtcccactcccaagaagccagcctgcctgtgtgtgtgggagaaagaacctcatctcagaatcccaagacttgttgctaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctgtacatcactcaccactactatgacaacgtcaagccgcgtcccggcggccacgccatgccctctgagatcttcaacttcctgcacttgcacagccgaggcatcctccgcgtgcacacgggcacctgcagctgctgctgatggctgccagccaggctgcccggcaagcggcaccccctctcctgctgtccctcctggtggaactgggagccccgaaccccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgacaggttcttctgtgacaccgagagatctaacccaaggcctgggttatgtcttagtcgagacatcatcatctgagaagcaccacatcctttcagacacatcctcggacacacatgcggtcttggtgcccccaggttcaatcctgcgttagctcttttgatgagaaggaaataaaccaaaccagccacttgca

SEQ ID NO: 283213 - DNA, 2460 bp, Homo sapiens
gcgatcccttgctgcgggcccggagatcaaacgtggcccgcccccggcagggcacagcgcgctgggcaaccgcgatccggcgccggactggaggggtcgatgcgcggcgcgctggggcgcacaggggacggagcccgggtcttgctccccattggccgccacctcggcgggaggggccgcctccggctcgtggcacctggcgtctcccctccgcggggaaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtacccccgcccccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctgtacatcactcaccactactatgacaacgtcaagccgcgtcccggcggccacgccatgccctctgagatcttcaacttcctgcacttgcacagccgaggcatcctccgcgtgcacacgggcacctgcagctgctgctgatggctgccagccaggctgcccggcaagcggcaccccctctcctgctgtccctcctggtggaactgggagccccgaaccccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgacaggttcttctgtgacaccgagagatctaacccaaggcctgggttatgtcttagtcgagacatcatcatctgagaagcaccacatcctttcagacacatcctcggacacacatgcggtcttggtgcccccaggttcaatcctgcgttagctcttttgatgagaaggaaataaaccaaaccagccacttgca

SEQ ID NO: 283214 - DNA, 2047 bp, Homo sapiens
  misc_feature (1754)..(1754): n is a, c, g, or t
agcggagagcgccgatggctggggacccgaggtccgcgccacccacccgcaacctccttccccgagcctttgggaacgggttgttggccagacaagtcccagaaactgcctgctttgaagcatgaataagtgcgaaaagactcttagcaatgaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtagagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacanacatacagaggctgtttccatagggacagagcaccgcagtgtgagagaggattgggctgggactgagaagggcgttcctgctgtggtgaggcagccctcagggtctctcctggcacacagctgccagcgtgatgggggatcccttcagaatagcagcaaaacccacgatactgaggagtaactcaaaccaaacttgtgggtctcacagagaggatatcgtcttgcccatgtaaagattccttttagatggtttctggtgtttactaatgttgttaataggtgtatttttcgga

SEQ ID NO: 283215 - DNA, 2106 bp, Homo sapiens
  misc_feature (1813)..(1813): n is a, c, g, or t
cgccgtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagggaccagccgggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtagagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacanacatacagaggctgtttccatagggacagagcaccgcagtgtgagagaggattgggctgggactgagaagggcgttcctgctgtggtgaggcagccctcagggtctctcctggcacacagctgccagcgtgatgggggatcccttcagaatagcagcaaaacccacgatactgaggagtaactcaaaccaaacttgtgggtctcacagagaggatatcgtcttgcccatgtaaagattccttttagatggtttctggtgtttactaatgttgttaataggtgtatttttcgga

SEQ ID NO: 283216 - DNA, 1686 bp, Homo sapiens
  misc_feature (4)..(4): n is a, c, g, or t
  misc_feature (6)..(6): n is a, c, g, or t
  misc_feature (18)..(18): n is a, c, g, or t
  misc_feature (20)..(22): n is a, c, g, or t
aagntngcggccgccgcncnnntcaggcagccccagcgtccccgggccctcggccccaccgagtgccggctcccgcgctctgcggcggcaagccccttggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtagagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttatcctcgtgccgcctcgtgccgaattc

SEQ ID NO: 283217 - DNA, 1995 bp, Homo sapiens
  misc_feature (4)..(4): n is a, c, g, or t
  misc_feature (6)..(6): n is a, c, g, or t
  misc_feature (18)..(18): n is a, c, g, or t
  misc_feature (20)..(22): n is a, c, g, or t
  misc_feature (1702)..(1702): n is a, c, g, or t
aagntngcggccgccgcncnnntcaggcagccccagcgtccccgggccctcggccccaccgagtgccggctcccgcgctctgcggcggcaagccccttggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtagagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacanacatacagaggctgtttccatagggacagagcaccgcagtgtgagagaggattgggctgggactgagaagggcgttcctgctgtggtgaggcagccctcagggtctctcctggcacacagctgccagcgtgatgggggatcccttcagaatagcagcaaaacccacgatactgaggagtaactcaaaccaaacttgtgggtctcacagagaggatatcgtcttgcccatgtaaagattccttttagatggtttctggtgtttactaatgttgttaataggtgtatttttcgga

SEQ ID NO: 283218 - DNA, 940 bp, Homo sapiens
cccaagaccacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgcgtgggagaagggttgctgcgggccaggctgtgggggggaagcccaccgggccgggcttggggcaagccccgtggtggtggcgcctggcccgcggtgaaatcggagggtgggccagataaatccacaaagggggggggaggaacag

SEQ ID NO: 283219 - DNA, 1106 bp, Homo sapiens
  misc_feature (1090)..(1090): n is a, c, g, or t
  misc_feature (1093)..(1093): n is a, c, g, or t
ggctcaaagtccaggccttcacaatggacagaacaccctcgttggtcttggggtccgtgcggaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgtgccgctgcggcaaggacggcgtctgcctgccgggggccgcagcgctgctggcggggggcacaggcctcagcctgggcgcactggtcatcgtgctggccagcgccctcctgctgctggtgctggtcctgctcgtggcactccgggcgcggttctggaagcagtctcggggcaaggggctgctgcacggcccccaggacgaccttcgagacaatgtcctcaactacgatgagcaaggaggcggggagggaggaccaggacgccttacgacatcagccagttgcgtcacccgaaaggctgagcctgcctctgggaccgccgncantttcgagaacttg

SEQ ID NO: 283220 - DNA, 1130 bp, Homo sapiens
  misc_feature (1114)..(1114): n is a, c, g, or t
  misc_feature (1117)..(1117): n is a, c, g, or t
cccaagaccacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgtgccgctgcggcaaggacggcgtctgcctgccgggggccgcagcgctgctggcggggggcacaggcctcagcctgggcgcactggtcatcgtgctggccagcgccctcctgctgctggtgctggtcctgctcgtggcactccgggcgcggttctggaagcagtctcggggcaaggggctgctgcacggcccccaggacgaccttcgagacaatgtcctcaactacgatgagcaaggaggcggggagggaggaccaggacgccttacgacatcagccagttgcgtcacccgaaaggctgagcctgcctctgggaccgccgncantttcgagaacttg

SEQ ID NO: 283221 - DNA, 779 bp, Homo sapiens
ttactgattctatagccattttataagccttggtgattgctccttagacctttcatggttggaaaaacagtgttattagggtaaaccagagttgtgctaaacagcagctgccatcatggtacacacagagacaaaggttatgaagccttacccttgaatacaaacttcctcctttgttgtgttcaaaccagcatgattacaaagtttaagtattgtcttcatattatgagtctatttcaatggaaaaattaacagaatggttttctttttcagctaaacagaaagaatttactgacaatgtgagcagtgcttttgaacaaggtactttcttttcttcactttcttaaatatggaaagaaatttcaagcactgaagcatagccattcattcaataactagctattatataccttcctatgatagctatatagggagatatgaaatacttatgagtctacatttctgtctttaaaaaaatgcctttaagaatctacatttctggcccaggcacggtggctaatgcctgtaatcccaacactgggaggctaaggcgggcggatcacgaagtcaggagattgagaccatcctggctaacatggtgaaactctgtctctactaaaaatacaaaattaactgggtgtggtggcacaacgcctgtagtcccagctacttgggaggctgaggcaggagaatcgcttgaaccagggaggcggaagttggagtgagctgagatcggccactgcacgccagcctgagtgacagagcgagactccatctca

SEQ ID NO: 283222 - DNA, 1129 bp, Homo sapiens
  misc_feature (1)..(2): n is a, c, g, or t
  misc_feature (5)..(6): n is a, c, g, or t
nncannagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaattcttgta

SEQ ID NO: 283223 - DNA, 870 bp, Homo sapiens
ggtacttgaggggcagggcctgggagactggaagacttgaatgaataggcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaattcttgta

SEQ ID NO: 283224 - DNA, 984 bp, Homo sapiens
  misc_feature (1)..(2): n is a, c, g, or t
  misc_feature (5)..(6): n is a, c, g, or t
nncannagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaattcttgta

SEQ ID NO: 283225 - DNA, 876 bp, Homo sapiens
  misc_feature (1)..(2): n is a, c, g, or t
  misc_feature (5)..(6): n is a, c, g, or t
nncannagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgcttgagccaaccatgcccggctggcagttgtatttctaaaggcccttctgatgattcca

SEQ ID NO: 283226 - DNA, 341 bp, Homo sapiens
ctcaacgtcaaaacaaaaacaaaaacaaaaaaactttgtgatttggatggtaatagtactatcttcatctccactaacagactgaaaaggacttctcagagaagcattcgaccctggtgaatgatgcctataagaccctcctggcccccctgagcagaggactgtaccttgtaaggtgatttcccaacacttctgtgtatgacgtcctgatgcccattatggcgtaggacagccacgtcccctttattcagcagaagagtgcttgaggtcaggcatggtggctcacacctgtaatcccagaactttcagaggctgaggtggtcagatcacttcagcccagg

SEQ ID NO: 283227 - DNA, 1074 bp, Homo sapiens
  misc_feature (1)..(2): n is a, c, g, or t
  misc_feature (5)..(6): n is a, c, g, or t
nncannagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaattcttgta

SEQ ID NO: 283228 - DNA, 548 bp, Homo sapiens
  misc_feature (1)..(2): n is a, c, g, or t
  misc_feature (5)..(6): n is a, c, g, or t
nncannagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagcctcccaaaatgcctggattgcaggcgcgagccaccacggccggctgaataaacatttgtcaaaagaagacatactagtggccaacatgtaaatgaaaaatgttctggataaacagaaactgattataaaacaaaaaacaaaa

SEQ ID NO: 283229 - DNA, 1739 bp, Homo sapiens
cggccgggaggtgagcgcactgttcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaat

SEQ ID NO: 283230 - DNA, 3619 bp, Homo sapiens
cggccgggaggtgagcgcactgttcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagcacacagattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaa

SEQ ID NO: 283231 - DNA, 3801 bp, Homo sapiens
  misc_feature (3481)..(3481): n is a, c, g, or t
  misc_feature (3483)..(3483): n is a, c, g, or t
  misc_feature (3487)..(3487): n is a, c, g, or t
  misc_feature (3490)..(3491): n is a, c, g, or t
  misc_feature (3494)..(3494): n is a, c, g, or t
cggccgggaggtgagcgcactgttcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaaaaaaaaananaaancgnnggngaaccgggcccgtcgacccgggaacagaagatgatccggaacacacgaaagcaagggagcccggagtcaggagcaccgcacacaccgctaacacccagaaagggcgctgcgcaccaatgacagaatcacagagagaatttccggaattacgcggagaagccgcgatccaataacaatagtaacgatctaccccacaaagaaacatcccagcctagagacgctcggggtccctcgaataccgcacgccctcctcaacaaatggaagcggacgtcgccccggcaaaatcggcaaaattgcgcaatgaaa

SEQ ID NO: 283232 - DNA, 1663 bp, Homo sapiens
cggccgggaggtgagcgcactgttcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagcacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaa

SEQ ID NO: 283233 - DNA, 3473 bp, Homo sapiens
cggccgggaggtgagcgcactgttcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaa

SEQ ID NO: 283234 - DNA, 3351 bp, Homo sapiens
gagcgtggtgggccaggaccggaagtctggctctgggtgttatttaaggtggctcctgtttttgtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaa

SEQ ID NO: 283235 - DNA, 459 bp, Homo sapiens
ccgctagctaatttgcttttattttttgtagaagtgggatcttgccaggttgcccaagctggtcccaaaatcatgggctcaggtgaacctcccacctgagtctcccaaagcattgggattacagccatgagccactgtacctagccccttactttccttttaacctgtcttctctaccagacaatgaataacttgagggcaaaaatgttttatcttgttcacctctgtattcctagctcctaacacataatgaatgttactagatagatggatgggtgctagatggctggatttcttcacgatgctatgctggcttcaaaccaaattaattaataaattaactaaatcagcatgggtccatcaatgactctttaagtgctttgcacggccccttcccctctcaagaacgggagtaagacatccaaagaaaggctggcctggcatctcaagactcacctc

SEQ ID NO: 283236 - DNA, 200 bp, Homo sapiens
aaggtatttctctttccataaaaaatacttcctgctctcgctggggcctttgtcgaaatgtttgcatgccactctctgcacacggcagggtgtggaacctcgacatgacccccagctgttctttgtaagggaaatgctttcttctcgtccatggtagcagagtgcctgcctcaagctggctggctttttaagaaggagaa

SEQ ID NO: 283237 - DNA, 1469 bp, Homo sapiens
agacgctggtagctcctggccagctcaaggtgtttccttttgcctggtaaccaggaggagtggctgaggcagggcatggagcggagcaacgcagctacaaagtgcggagaggagccccgctctggatcccgccggctccccaaggctgaaggagacaagtctggatccgcaggagcccccagtaagaacagcagccgcctggggggccgaccatgtatgtgtacagctggccgccgcccaaacagggcgtctggccgccgccgccgcagctgctcacctgcacctacctggccgcccctctgctgctacccccagtccaggcccacagcttccgcagccggcccgggagcctgcatgcgggcgagtgggcggccccacgggaataccaccgcttctacggccccgccgcgccacccgaggccgcgccgccctggtgggcctgccctccggcctacgccacgaccctgcgccggccctgcgccgccgccggcatctcgggactgtcgctgcaggcgcccgcggcggtggccgagagctgggcgccgtggccggagggcgggagcctgcaaaccgagctgcgctggggccgcgtggagcgcgcgcggggcccccctctgcagctaccggacttcgtgcgccgggagctgcggcgcgcgtacggcacctacccccgcgccgacgtgcgcgtcacccagcgccgcggccagttcctgctgcaggcgacgccgcgcgtgctcgagcccgaccaccgcgtggagtggcgcgtgcggcgccggcccgacagcggcgacagcagcccagcccgggaagccgcggagcgcggccgccccaggaagagcaagggcctgagctgaagccgccgcaaggcctaggggcgggcccgcgtgcacgcgcttggctctttcctgtgtgtgccgccgccgacaggcagaagtgagccctcacctgtgcgcgggaggcggacgcgctgctcacctgtctttttggcttctcccatgactgccggccagtttcctgcacttgtttctctcgctttattgctggacggtgggagaagggcaagtgcaagacggaatcgagggcacctctgggtgttctgtacctcttttcttcttgcaccttgggaagtggaggacgtgggatggaagaagggcctggacctccctccttcctcctccccaccttctcctaaggagcttgccctgcagtaagccccaactttcccttcctcttttccctctatcagagtcgtcgcccacccccctttcccaccgctcccctacccccgccttcctgccaagccgagggcgacggagatccccagcttagtaagaaaagtaaataggccgggcgcggtagctcacgcctggaatcccagcactgtgggaggccgaggcgggcggatcgcttgagcccaggagaccaggttggagaccagcctaggcaacatggcgaaaccctgtctctac

SEQ ID NO: 283238 - DNA, 960 bp, Homo sapiens
cgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacagga

SEQ ID NO: 283239 - DNA, 1134 bp, Homo sapiens
tatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacagga

SEQ ID NO: 283240 - DNA, 1063 bp, Homo sapiens
cgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccaggagtggtccacagttgtcattacccagtggtcagtgaaggaaggaaggcaagagtggcggaacaccgctggagaaacagataactacatgtggcatgttaactcctgtcaaagacatgttcactgaagactctcctgagcttttccaggatgtatgtccaggagatcctgttggcacatccaaacatttccccttgtgactgcacataagcatggtcacctgacagggatcaggcccactctcctttagagggtggaatcccactgaactgagacttcctttcaacagtccccatcccacttctgcaacactatttgggccagtggtgtccagagggggaagccatctttctttccatcaagagacacaatacaccagaagtctagagcataccacctgtcatgtattggacaataaactattgcttgtgttaattttcagt

SEQ ID NO: 283241 - DNA, 1144 bp, Homo sapiens
cgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccaggagtggtccacagttgtcattacccagtggtcagtgaaggaaggaaggcaagagtggcggaacaccgctggagaaacagataactacatgtggcatgttaactcctgtcaaagacatgttcactgaagactctcctgagcttttccaggatgtatgtccaggagatcctgttggcacatccaaacatttccccttgtgactgcacataagcatggtcacctgacagggatcaggcccactctcctttagagggtggaatcccactgaactgagacttcctttcaacagtccccatcccacttctgcaacactatttgggccagtggtgtccagagggggaagccatctttctttccatcaagagacacaatacaccagaagtctagagcataccacctgtcatgtattggacaataaactattgcttgtgttaattttcagtatttcaagatgtagaatacttgctttgagaacaaaacataataataattgtaaagtctaataaaaatgtttctaagtggga

SEQ ID NO: 283242 - DNA, 1324 bp, Homo sapiens
cgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggat

SEQ ID NO: 283243 - DNA, 1077 bp, Homo sapiens
tatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacagga

SEQ ID NO: 283244 - DNA, 981 bp, Homo sapiens
cgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtaagtactcttctcagtctgtttccagctcacaggaagtgtatataaattaatattctcaaccaagagacatgaatttcctatatgacttttgaaagtaagacatactgataaatggtaactgatgacatcattcaagattaaatgtgtcatatgccacatacgcaaaatatgcatttaattagtttgctagtgttgcagtgtcttgtctcgaaacagttcaaggcatcaaatttagaactataaacttcatcgtttgctgtacatcatgaaactgaggtcaagtagaggaaacgtgaaaggtgtcagacggagaggaaagaatgatgcggtgtgcgaatagaaaattaaaaccttgccttgattgttgcccactcaaaatgatatttgccagatgctagtttctgggtcttttaaatttgctgtattaactactgtcttaacaagctcctcctaataaacctttat

SEQ ID NO: 283245 - DNA, 1173 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtcca

SEQ ID NO: 283246 - DNA, 1290 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtccaaaaaaaaaaaaaaaaaagcggggcgacaaaagatcccgggggcccactaacgccccgttttttaaagggccaaaggaaaaaaagagcccgccgtaaacacagaaacgctggcttaac

SEQ ID NO: 283247 - DNA, 1016 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtgagtggcgtggggcggcgacgtaggggctcccggtccctagcttcagttcggccattatgtcccgggagccgagtgcccccaaattgctgctctgttttcttaactggcttggcttggactcatcgtcaacagcagcagcatcatcatcatcaccatcatcatcatcatcatcatcatcatcatcatcatcatcaatggctgagccctcactgtgcttcctgggagccgggctcagcttcccgcctccacgggcactacaggagggaacaaagtcacctgtcaggatcatgtggaaagaggccaagggtggatttaacccaggcaccacatgattggagagggagcatctgcaaagatggagccctgcagtgcctgcgttagaaaagcattctaaggctgaggtgggcgaatcacctgaggtcaggagttcaagatcagcctgaccaacgtggcaaaaccctgtctctactaaaaatacaaaaattagctggacatggtggtggctgcctgcaatcccaactactcggaggctgaggcaggagaatcacttgaaa

SEQ ID NO: 283248 - DNA, 1080 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtcca

SEQ ID NO: 283249 - DNA, 1027 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctggcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtcca

SEQ ID NO: 283250 - DNA, 1062 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtcca

SEQ ID NO: 283251 - DNA, 1522 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtgagtggcgtggggcggcgacgtaggggctcccggtccctagcttcagttcggccattatgtcccgggagccgagtgcccccaaattgctgctctgttttcttaactggtgagttcagtgctcgacgggctccaaacttcttgaagctccgttcctgcactagggcgccctgcctgcccagccttctggagttctcaggggtcgggtttctgggccccttcttcgcgccccttccccactgcagcgttgctctgcgtttccgctcctctgcgttggggcccacgggacgctgtgagatcgggggtggcgagagttgttgggcctcagtttccctggtgccgcccgcaggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtcca

SEQ ID NO: 283252 - DNA, 1429 bp, Homo sapiens
ggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtgagtggcgtggggcggcgacgtaggggctcccggtccctagcttcagttcggccattatgtcccgggagccgagtgcccccaaattgctgctctgttttcttaactggtgagttcagtgctcgacgggctccaaacttcttgaagctccgttcctgcactagggcgccctgcctgcccagccttctggagttctcaggggtcgggtttctgggccccttcttcgcgccccttccccactgcagcgttgctctgcgtttccgctcctctgcgttggggcccacgggacgctgtgagatcgggggtggcgagagttgttgggcctcagtttccctggtgccgcccgcaggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtcca

SEQ ID NO: 283253 - DNA, 2225 bp, Homo sapiens
ggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgcacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaacggtgatgaagtgagcgagcaggagtgtgcgtcaggccccccacagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgaaaaatgagctcttccttgtcggctatggacccctcagcagtgtgaaggcagaaggtagggtgggcaggggaacagcattagagcccaggagagtttgggtcagagaatccccgccagccccaggccctgcaggctggtcatgggccactagaggtcaccagttctcccatttg

SEQ ID NO: 283254 - DNA, 751 bp, Homo sapiens
ggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgcacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaacggtgatgaagtgagcgagcaggagtgtgcgtcaggccccccacagccccccagcagagaggcctgtgacatggggccctgtactactgcctggttccacagcgactggagctccaaggtgagcccggaacccccagccatatcctgcatcctgggtaaccacgcccaggacacctcagcctttccagcatagctcaataaacttgtattgatcaagcgc

SEQ ID NO: 283255 - DNA, 2047 bp, Homo sapiens
ggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgcacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaacggtgatgaagtgagcgagcaggagtgtgcgtcaggccccccacagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgaca

SEQ ID NO: 283256 - DNA, 1398 bp, Homo sapiens
ccctgccctcccccatccacgatgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgaaaaatgagctcttccttgtcggctatggacccctcagcagtgtgaaggcagaaggtagggtgggcaggggaacagcattagagcccaggagagtttgggtcagagaatccccgccagccccaggccctgcaggctggtcatgggccactagaggtcaccagttctcccatttg

SEQ ID NO: 283257 - DNA, 2490 bp, Homo sapiens
ggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgcacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaacggtgatgaagtgagcgagcaggagtgtgcgtcaggccccccacagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacatgattgacataaaaaaaaaaaataagaataaaaaaaaagtagtggtggagccgctttaaaatatactccatcaaagagagtgcccaagtatataacgtataccgcacggatttttgtggtggtaccaatagggtgatccccctaatataagaggacacagaataaataaaagcattagggcaaattagcccattgatgttttatactaaagttgccttagaagacgtgggggagaaaacatcatgggacattaaatgttgagggaaacatttttgttgagacaaagatgacatcacttatagttatacaaggagggtgagttgtaacaaataatttgaggaagaaaaaaaacagcataaaaggagtagttattataacgagccttcatggagggtacaattatttacagtatacttagtagtgtgagtataaatgggttgaaa

SEQ ID NO: 283258 - DNA, 3496 bp, Homo sapiens
ggggcagtattctgtgttgagggaggaaaaacactcccttccaaaagcatgacaggcagaaagcagagaagggccaggactggctgagggcggggagctgggcctctggggtggacacacccttggtcacattgtgagggtagcttggttggccagtcccaccactgcagtgaccacagttgtgttgggctcacaccagtgaaccgaagctctggattctgagagtctgaggattccgtgaagatctcagacttgggctcagagcaaggatgcgtgaaattgtccatattcagattggccagtgtggcaaccagatcggagccaagttctgggagatgattggtgaggaacacgggatcgacttggctgggagcgaccgcggggcctcggccttgcagctggagagaatcagcgtgtactacaacgaagcctacggtaggaaatatgtgccccgagcagtcttggtggacctagaacctgggacgatggacagcattcgatctagcaaattaggagctctctttcaacccgacagttttgtccatggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacacggtggtggagccctacaacgcggttctgtctatccaccagctgattgagaatgcagatgcctgtttctgcattgacaatgaggccctctatgacatctgcttccgtaccctgaagctgacgacacccacctatggggatctcaaccacctagtgtccttgaccatgagcggcataaccacctccctccggttcccgggtcagctcaacgcagacctgcgcaagctggcggtgaacatggtccccttcccccgcctgcacttctttatgcccggctttgccccactcacggcccagggcagccagcagtaccgagccctctccgtggccgagctcacccagcagatgttcgatgcccgcaataccatggctgcctgtgacctccgccgtggccgctacctcacagtggcctgcattttccggggcaagatgtccaccaaggaagtggaccagcaactgctctccgtgcagaccaggaacagcagctgctttgtggagtggattcccaacaacgtcaaggtggctgtctgcgacatcccgccccgggggctgagcatggccgccaccttcattggcaacaacacggccatccaagagatctttaatagggtctctgagcatttctcagccatgttcaaaaggaaagcttttgtgcactggtacaccagcgaagggatggacataaacgaatttggggaagctgaaaataacatccatgatttggtatccgagtaccaacaatttcaagatgccaaagcagttctagaggaagatgaagaggtcacggaggaggcagaaatggagccagaagataagggacattaactgtgagagaagctgtgccgcggagtcgcttacagaacagtttctcattagatgagtgtttctcctgcagcactccaaaacccactctgcactgcagcacagtgaatgatatgcactcaccattagcttcgacacagggactgagggagacaggtggggagcagctgacaggcattagggtctttgctgacatctactaaccttgaagagtttgatgttcagtgcatacttattaacttaaaaaaatagcaaatttattgtaaagtgctccctttgtttcaaagtgtttgccaggcatccagactacacgtgtggatttgcagggagccactggagttggtgttacatttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaagacaagcaaaactaaagaactgcagtcttctgatctttatttctgaagagctagcctttaacatatatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaagggcacaccatgcgctcggcaaccattcaaatgcaggaattaagcagcaatggctgcagtgtccttctcagttatggaggacatcgtctcattagggaacttttacagttcaaattaatttgcagaagttgccataaatgtttgcataatgacatagctttaagcactacatgattttaatctgctcacattataacaggaccaaatacacaagagcgtaatcaaatcatctgtaacttcttaattacagtttacctatttctgacatgcagcactgccatctcttccagcaccatcagggttttaatggccctctagaattaccactgagatacactatttgatccatggataaccggtaatgggaaaatgctccgaccctcaatgcagtaaatatttacttgcaggcaactgggttctcatctcttgatttgcttttgtaatcagcaataataaaatagcaggtagatggatgacagttgctcattctgagaaacttcactcttttcacttatgcatcacgaggaaataactaaaatacataccaagagaaaaataccttgccatcggatcatcaacaagtcttctatttacaaacttcaaaaaacacaaaacaacattcatgttttaaatgctttctacttgtggttcaagaagcactagatttagtaagaaactctacctatatacttagtttgaagttagtaacttcctgagatgctaaagacttacagcctgcgattatacaaggatttacacatgcttcctctggtgctttacttcccaaacctaaaaaagcaatgaaatagatgtaaggaaggagggatttaaaccttttaaaaaacttttgctgacttatattactgtaaagatttgtttgctcaatagtaatcattaaactacaaagtaattcaattttaaatggcaaaattgctttatttcagactaaataaattccttttcttgaagcctaa

SEQ ID NO: 283259 - DNA, 399 bp, Homo sapiens
ttgataaaacattaacttttagaaaaacaagtaggctgactttttcctatttttctacacaggtaggaaatatgtgccccgagcagtcttggtggacctagaacctgggacgatggacagcattcgatctagcaaattaggagctctctttcaacccgacagttttgtccatggtatgtttttccagaaggttccaccaggaggagggggggatgctttactggtgcccttctcttttcacctttcttcccctgctggtttctctttttggccacaggtaactctggggctggcaacaactgggccaaaggccactacacggagggagccgagctgatcgagaatgtcctagaggtggtgaggcacgagagtgagagctgtgactgcctgcagggcttc

SEQ ID NO: 283260 - DNA, 417 bp, Homo sapiens
tctctttcaacccgacagttttgtccatggtatgtttttccagaaggttccaccaggaggagggggggatgctttactggtgcccttctcttttcacctttcttcccctgctggtttctctttttggccacaggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacacggtggtggagccctacaacgcggttctg

SEQ ID NO: 283261 - DNA, 1421 bp, Homo sapiens
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaa

SEQ ID NO: 283262 - DNA, 2447 bp, Homo sapiens
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgttctactgatggttgttttaaattaataatgagaactataatttaaataatatttctttgttagacattataatgttaaactgaaagactaaattctgcaagtactatataatatttttggcttataatgctacatttttattaatgtaccttccgttttgaggatttatatctgtatttctctttgcattatacaaatataccagtattttcattctgga

SEQ ID NO: 283263 - DNA, 477 bp, Homo sapiens
gtcctgtgatgacctgtggcggaaggtaaaccgaaggtgactgcggttaacgtcctcgatgggaatggccaccttcaagaattgaaaaagaagtttaagcactgttatcaatatcatccagcgtaacagctttattcaactggagctatcagagccaacccctggcctggttttcaaatattcaagctcttggcggtgagacggtgtttactccatcgtggagatgtgagcacgctgcattatgaaaaggcaccatatcagagctacagaacaggatcccactccccagcaatgacctccacaggctggcagctcggtttttttgtttggtgtaaagacagcatgccacacataaaacagtactgggaagagaaagacaatagctatcttaaaaagactctgtcatttgtctccatgaacgtcctatttttacgtccaaaaggagatgagagtaaatgtattctaagaaacaccagt

SEQ ID NO: 283264 - DNA, 290 bp, Homo sapiens
cgggggccttaaagcttctttttttggaaagtggcttttatggtcgggccacggtataatttgccctgcccagtgagggcagctgctgaggaatgcaggggaggaagaacctgagacagcgccacgttcctggtaatatagtcccatgatcccacacaaagaagattcctggccgggcacaatggctcacacctctaatgccagcactttgggaggccgaggagggaagatcacttgagctcaagagttcgagaccagcgtgggcaacatagtgagacaccattcctaca

SEQ ID NO: 283265 - DNA, 713 bp, Homo sapiens
gtatgtaattaagtaaaagtttatttatttttttcaataaaagaaaaagtctgagtatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaagtatgatgtgatagtcatgaatttgtgtcttttgctccgctttatttttaaacaataaaattaaggctacaaaattttccctgaacatagctttagctgtatccaatagtttttgatacaatgtttttttcttttcccttttggatacttaatttgtagtttcaattttgatttctcctgtgaactaggaattatgtggaagagatttcttaatgtcccattaatcagagacttaagaaatcattttattgccttatctcttctttgaatgaatgaaagtttaaaaatctgcttttgggaaatcaattgcagttttatttaatgccattaatcaagtatatgattaatttgtgtgttacgtgaatatgagaaaaaaattatagtttattgtattttttaatcccttatatctttaattgtatacttgaattgttcaattctgaaagaatattggaacctcccacaataaatatatttttatcaatt

SEQ ID NO: 283266 - DNA, 1662 bp, Homo sapiens
ggccgcctcctggggcagaatggaacagcctgggcccagggctccggatccctctctctgccaccacaacctccagccaaggtttttaaacactcgaggaagtgcctggctaagaggggacaggaaaaaaggaagaactggtgattttccaaggaaaacagggccaaaggcaaagaagaaagagaagtcctggaagctctgaagagaacaggtcctgcctgagtcccgatccccatataggatcttggaaacagcaagcagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagctcagaagattaagaaaagttctcacttgtctctggaatggaaaaagttacttccccaacctccagacactgaattccgaaggaattaccaaattccagctaaaattcctgagcttcaagatttcagtttcaaatatggatgctactcaagcttgcctgttgcttctcagggtctagtgccttctgtgctgcacagctacctgaggaaccaagagcacacaaagaaacagaccacataccaaagtgactacgacaaaacctacccagatttcttaatgcttttaaactcatttacttcctctcaagtcaaagagtaccttcagagtctttcctacaaagatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaagtatgatgtgatagtcatgaatttgtgtcttttgctccgctttatttttaaacaataaaattaaggctacaaaattttccctgaacatagctttagctgtatccaatagtttttgatacaatgtttttttcttttcccttttggatacttaatttgtagtttcaattttgatttctcctgtgaactaggaattatgtggaagagatttcttaatgtcccattaatcagagacttaagaaatcattttattgccttatctcttctttgaatgaatgaaagtttaaaaatctgcttttgggaaatcaattgcagttttatttaatgccattaatcaagtatatgattaatttgtgtgttacgtgaatatgagaaaaaaattatagtttattgtattttttaatcccttatatctttaattgtatacttgaattgttcaattctgaaagaatattggaacctcccacaataaatatatttttatcaatt

SEQ ID NO: 283267 - DNA, 1484 bp, Homo sapiens
ggccgcctcctggggcagaatggaacagcctgggcccagggctccggatccctctctctgccaccacaacctccagccaacagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagctcagaagattaagaaaagttctcacttgtctctggaatggaaaaagttacttccccaacctccagacactgaattccgaaggaattaccaaattccagctaaaattcctgagcttcaagatttcagtttcaaatatggatgctactcaagcttgcctgttgcttctcagggtctagtgccttctgtgctgcacagctacctgaggaaccaagagcacacaaagaaacagaccacataccaaagtgactacgacaaaacctacccagatttcttaatgcttttaaactcatttacttcctctcaagtcaaagagtaccttcagagtctttcctacaaagatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaagtatgatgtgatagtcatgaatttgtgtcttttgctccgctttatttttaaacaataaaattaaggctacaaaattttccctgaacatagctttagctgtatccaatagtttttgatacaatgtttttttcttttcccttttggatacttaatttgtagtttcaattttgatttctcctgtgaactaggaattatgtggaagagatttcttaatgtcccattaatcagagacttaagaaatcattttattgccttatctcttctttgaatgaatgaaagtttaaaaatctgcttttgggaaatcaattgcagttttatttaatgccattaatcaagtatatgattaatttgtgtgttacgtgaatatgagaaaaaaattatagtttattgtattttttaatcccttatatctttaattgtatacttgaattgttcaattctgaaagaatattggaacctcccacaataaatatatttttatcaatt

SEQ ID NO: 283268 - DNA, 8950 bp, Homo sapiens
cgcacgttgaatcgcgtggtgactccgggcttgaggttggaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatgccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacatttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacacgctgcagctgatggtgcagtcgggagccaaaggttcaactgtgaacacgatgcagatctcgtgcctgctgggccagattgaactggaaggtcggagcaccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggagacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttgtacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggccagcctgcaagggtaagacattcattctttgagttaaaggccatattcacttgatgatttctacacacactagaattgtgagagtgtccttgaaggagatcacaaagtaacctggtgactgtggcacagggtccgtggattccatctctcccaggcactgagggcgcagaggcgaaggagcaagccctgcatattggcagggctgtgaccatcgcacttagatcagacccccgacctgtgttgggatgtgagggatgccctcctgccccacccatccacatggttcctgggcagctctgttttattcctgtgtctttcctgatggatgagtattaagacagcatgtctggtttttaaacagacatttgggagcttgcacatcctgatgagcagggactcactgtggtggccttagggaattacacgctcactttggtggttctctatgctcggaagcctctgagagtggccttggcagcttaagatggcagaggctttggagtcttcttaggactgtaagtgcccattgaggatgcatttgagttttggaaagtaggcccaagtcaaatctgatggatggattcaagaacatggactaatctgcgttgtcatttttaatcaaaatgtaatggagattgatcatctggtggggttcacaaacttttcatgagagctgtgagttctttttttgagatgcacttttgcacttgttacccaggctgagtgcaatggcgcaatctcggctccactgcaacctccatctcccgagttcaagcgattctcctgcctcagcctcccgagtagctgagattgcaggcatgcgccaccacgcctggctaatttttgtattttagtagagatggggtttcaccatgttggccaggctagtctcgaactcctgatctcgggtgatccgcctgcctcggcctcccaaagtgctgggtttacaggcgtgagctactgtgccggccagagctatgagttctttcagaatcctcagatgccattagctagccactgtttggacatccttctcaccttgccctttggggtgatatccatacctacttgcttgcttctaacagtttttttatttgttttgtagagacgggttttggtttattgctcaggctggtttcaaactcctaggctcaagcggtcctcccactgtggcctcccaaagtgctgggtggtgtgagccaccgtgcctggccagttaattttttttagtgtctcttttttgggttctcaccagaaacactatcagcattcccacagatattcctgtgagtctttgaaacattttctatcctgcattgagtaagaataaaaccgaggaaggggtgaagcaccttgtctcatccccagtctggaacttgaaccttcttttctcttcactttgccctacccccaaataatatgtacaaatgtctgtatccattgagcactaactccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatctgaggtcaggattcgagaccaccctggccaacatggcaaaaccccatctctactaaaaatacaaaaattagctgggtgtggtggtgcgcgcctataatcccagctactcgggaggctgaggcaggagaatcttgaactcaggaggtggaggttgcagtgagccgagattgcgccactgcactccagcctgggtgacagagtgagattccgtctcaaaaaaaaaaaaaaacaaaaactcaga

SEQ ID NO: 283269 - DNA, 6875 bp, Homo sapiens
cgcacgttgaatcgcgtggtgactccgggcttgaggttggaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatgccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacatttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacacgctgcagctgatggtgcagtcgggagccaaaggttcaactgtgaacacgatgcagatctcgtgcctgctgggccagattgaactggaaggtcggagcaccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggagacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttgtacaaaggctttgtaaaaccagaggctagcttctatctttgtctactgttatttcagctcagggcgggtaattaacatcattggaactagctattaggaaagaaaaaaaacttggttttttttacaacaaaaaaaaaaaaaaaaaaaaaaaaaaaaaaaaaaaataataaaaaacaaaaaaaaaaaaaaaaataaaaaaaaaaagaaaaacaaaatcacaaaacatacaaaaaatcacagtgcgcctcacacaatacctcaccaatgccagaccctatgtcatctcttactgttctgatgttgattgaatgggcggcgctactctaactgagacgcgactgtctatatataaaacagaaccgcggtgggagaggacatacgaaaaaacatacctgtgtggtatgtgagaagacaagtgtacgctggttcgtgtgcttctctagtctggtagagaccgcaccctccatccagggccgaggaggcccattaacatcaccggcgctctacgcttccctcaaggacgttatataccgctcgtctgtagctggtctcacttcgtcttcgcgggcgcgtgggtgcccgtacctaccacgtcgtccccttcggcggccgtcctacacgttcgtcgcgtctcgtaca

SEQ ID NO: 283270 - DNA, 6213 bp, Homo sapiens
  misc_feature (90)..(90): n is a, c, g, or t
ggttctggggagctctgcattgtgggagagtgtaggggcagacagtcatctcagcagctggggctagatgggagcccaggtctaggggtngagccaagctgctcagtaacatggctgcagcctcctcctcctagaaaaccatcaggaaatgcagccctggctgggggacactggagcaagcccagaccccggggcattggatctagcctgttctgaagtcttgtttgcctgcagaacaggagcccccctttccctcccctccactgcccccaaccctcatcagaggctgccctggggaggtgatgggccggcggggactgagccgatggtgtccttacaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggagacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttgtacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggccagcctgcaagggtaagacattcattctttgagttaaaggccatattcacttgatgatttctacacacactagaattgtgagagtgtccttgaaggagatcacaaagtaacctggtgactgtggcacagggtccgtggattccatctctcccaggcactgagggcgcagaggcgaaggagcaagccctgcatattggcagggctgtgaccatcgcacttagatcagacccccgacctgtgttgggatgtgagggatgccctcctgccccacccatccacatggttcctgggcagctctgttttattcctgtgtctttcctgatggatgagtattaagacagcatgtctggtttttaaacagacatttgggagcttgcacatcctgatgagcagggactcactgtggtggccttagggaattacacgctcactttggtggttctctatgctcggaagcctctgagagtggccttggcagcttaagatggcagaggctttggagtcttcttaggactgtaagtgcccattgaggatgcatttgagttttggaaagtaggcccaagtcaaatctgatggatggattcaagaacatggactaatctgcgttgtcatttttaatcaaaatgtaatggagattgatcatctggtggggttcacaaacttttcatgagagctgtgagttctttttttgagatgcacttttgcacttgttacccaggctgagtgcaatggcgcaatctcggctccactgcaacctccatctcccgagttcaagcgattctcctgcctcagcctcccgagtagctgagattgcaggcatgcgccaccacgcctggctaatttttgtattttagtagagatggggtttcaccatgttggccaggctagtctcgaactcctgatctcgggtgatccgcctgcctcggcctcccaaagtgctgggtttacaggcgtgagctactgtgccggccagagctatgagttctttcagaatcctcagatgccattagctagccactgtttggacatccttctcaccttgccctttggggtgatatccatacctacttgcttgcttctaacagtttttttatttgttttgtagagacgggttttggtttattgctcaggctggtttcaaactcctaggctcaagcggtcctcccactgtggcctcccaaagtgctgggtggtgtgagccaccgtgcctggccagttaattttttttagtgtctcttttttgggttctcaccagaaacactatcagcattcccacagatattcctgtgagtctttgaaacattttctatcctgcattgagtaagaataaaaccgaggaaggggtgaagcaccttgtctcatccccagtctggaacttgaaccttcttttctcttcactttgccctacccccaaataatatgtacaaatgtctgtatccattgagcactaactccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatctgaggtcaggattcgagaccaccctggccaacatggcaaaaccccatctctactaaaaatacaaaaattagctgggtgtggtggtgcgcgcctataatcccagctactcgggaggctgaggcaggagaatcttgaactcaggaggtggaggttgcagtgagccgagattgcgccactgcactccagcctgggtgacagagtgagattccgtctcaaaaaaaaaaaaaaacaaaaactcaga

SEQ ID NO: 283271 - DNA, 3367 bp, Homo sapiens
cgcacgttgaatcgcgtggtgactccgggcttgaggttggaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatgccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacatttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacacgctgcagctgatggtgcagtcgggagccaaaggttcaactgtgaacacgatgcagatctcgtgcctgctgggccagattgaactggaaggtcggagcaccccgctgatggcgtctggcaagtcactgccctgctttgagccttatgagttcacccccagggctggtggctttgtcactggcaggttcctcaccggcatcaaacctcctgtatgtattttggtttttccatttagctttttccctcatttctaggcttaattgtaggtgaactatgactgccctacagggtagggcagaagacactgggggctattgtagctgtcgaggtcaaaaagtcctaggagatcagggaagggagtggcctgtctggtcaggaaaggctgctggaggtgttggcctgagcccttcaggaagcgcactgtcctcactgtcacctttgacctgggtcccattctctgcaggagttcttcttccactgcatggcaggacgagagggcctggtggacactgctgtgaaaaccagccgctcaggctatctccaaaggtaaaatgtatctgccgtgccccttgaggtagagtg

SEQ ID NO: 283272 - DNA, 2831 bp, Homo sapiens
cacttacggctaggtacgaggctgggtgttgcctgttcttggccgtccacgtttcctctccctctagcaccagcaatacatttccctggcatggacagaaaagacagagaggacttgtacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggccagcctgcaagggtaagacattcattctttgagttaaaggccatattcacttgatgatttctacacacactagaattgtgagagtgtccttgaaggagatcacaaagtaacctggtgactgtggcacagggtccgtggattccatctctcccaggcactgagggcgcagaggcgaaggagcaagccctgcatattggcagggctgtgaccatcgcacttagatcagacccccgacctgtgttgggatgtgagggatgccctcctgccccacccatccacatggttcctgggcagctctgttttattcctgtgtctttcctgatggatgagtattaagacagcatgtctggtttttaaacagacatttgggagcttgcacatcctgatgagcagggactcactgtggtggccttagggaattacacgctcactttggtggttctctatgctcggaagcctctgagagtggccttggcagcttaagatggcagaggctttggagtcttcttaggactgtaagtgcccattgaggatgcatttgagttttggaaagtaggcccaagtcaaatctgatggatggattcaagaacatggactaatctgcgttgtcatttttaatcaaaatgtaatggagattgatcatctggtggggttcacaaacttttcatgagagctgtgagttctttttttgagatgcacttttgcacttgttacccaggctgagtgcaatggcgcaatctcggctccactgcaacctccatctcccgagttcaagcgattctcctgcctcagcctcccgagtagctgagattgcaggcatgcgccaccacgcctggctaatttttgtattttagtagagatggggtttcaccatgttggccaggctagtctcgaactcctgatctcgggtgatccgcctgcctcggcctcccaaagtgctgggtttacaggcgtgagctactgtgccggccagagctatgagttctttcagaatcctcagatgccattagctagccactgtttggacatccttctcaccttgccctttggggtgatatccatacctacttgcttgcttctaacagtttttttatttgttttgtagagacgggttttggtttattgctcaggctggtttcaaactcctaggctcaagcggtcctcccactgtggcctcccaaagtgctgggtggtgtgagccaccgtgcctggccagttaattttttttagtgtctcttttttgggttctcaccagaaacactatcagcattcccacagatattcctgtgagtctttgaaacattttctatcctgcattgagtaagaataaaaccgaggaaggggtgaagcaccttgtctcatccccagtctggaacttgaaccttcttttctcttcactttgccctacccccaaataatatgtacaaatgtctgtatccattgagcactaactccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatctgaggtcaggattcgagaccaccctggccaacatggcaaaaccccatctctactaaaaatacaaaaattagctgggtgtggtggtgcgcgcctataatcccagctactcgggaggctgaggcaggagaatcttgaactcaggaggtggaggttgcagtgagccgagattgcgccactgcactccagcctgggtgacagagtgagattccgtctcaaaaaaaaaaaaaaacaaaaactcaga

SEQ ID NO: 283273 - DNA, 732 bp, Homo sapiens
cgcacgttgaatcgcgtggtgactccgggcttgaggttggaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacagggtaggtgggtagtggtggtcacagaaatcagaaaaggcaaagtggtgtggggaacaagagatgcttgtatgttgtcctagttaccatgccgatagtcatcagaacgtttgatctttatatcttataactggataccaatagctgagtgtgaaaacaggaagctataagaataataaaagaaatgttcataga

SEQ ID NO: 283274 - DNA, 576 bp, Homo sapiens
actcgggaggctgaggtgggaggatcactggagcccaggagtttgaggctgcagtgagtcgaggttgcaccactacactctagcctgggcaacaggagtgagaccttgttaaaaaaaaaaaaaaaaagacagaataatgctgcctgtgaagcagtcagtgtatagtagatgcttaactcctttttatgaacagtttaccagtgtacttagtgcaagttttgttctaaatctgtttttaagaagttaccactcattcatttagcacatatgtattttatgacttattcatttagcacatatgtatttattaactattgggtaccaactctgcacttagtgttggggtacactagtgagaaagacagattgtgccctccagagctatcaagcaggcattaaataatcacttaactataggtttgtgctggaaaggaaacatcagagaggttggtaactttagctttcctcttggtcttttttatccccttaggaaattaagtgttaaatccattacgaaccctcgatacctggacagcctggggaacccatcggcaaacggcctgtacgatttagctt

SEQ ID NO: 283275 - DNA, 407 bp, Homo sapiens
gagattgatttttgtggtcaagttgcaggcttggggataaagaattgataaatcccattgcagaaagagtacctgtttctgatttattgcactttgattctcctccttggctccaggaattgaggaagctcagataggaaaacgaggatacttaacacccaccagtgcccgcgaacacctttctgccctgtggaagaatgaaggtgctgtatcaggctaaagaaatagccttgatcttctctaggcttttatttcctggactcattaaccctgccttattacttcttttaagttgtaatgattgtagcttcctcctggaactgatccagaggtttggggcagtcttcagggcacattgacattgagtcatagagcaggagaggtcatacccagcaccaaaaacttga

SEQ ID NO: 283276 - DNA, 7649 bp, Homo sapiens
cgcacgttgaatcgcgtggtgactccgggcttgaggttggaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatgccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacatttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacacgctgcagctgatggtgcagtcgggagccaaaggttcaactgtgaacacgatgcagatctcgtgcctgctgggccagattgaactggaaggtcggagcaccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggagacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttgtacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggccagcctgcaagggtaagacattcattctttgagttaaaggccatattcacttgatgatttctacacacactagaattgtgagagtgtccttgaaggagatcacaaagtaacctggtgactgtggcacagggtccgtggattccatctctcccaggcactgagggcgcagaggcgaaggagcaagccctgcatattggcagggctgtgaccatcgcacttagatcagacccccgacctgtgttgggatgtgagggatgccctcctgccccacccatccacatggttcctgggcagctctgttttattcctgtgtctttcctgatggatgagtattaagacagcatgtctggtttttaaacagacatttgggagcttgcacatcctgatgagcagggactcactgtggtggccttagggaattacacgctcactttggtggttctctatgctcggaagcctctgagagtggccttggcagcttaagatggcagaggctttggagtcttcttaggactgtaagtgcccattgaggatgcatttgagttttggaaagtaggcccaagtcaaatctgatggatggattcaagaacatggactaatctgcgttgtcatttttaatcaaaatgtaatggagattgatcatctggtggggttcacaaacttttcatgagagctgtgagttctttttttgagatgcacttttgcacttgttacccagtgcactccagcctgggtgacagagtgagattccgtctcaaaaaaaaaaaaaaacaaaaactcaga

SEQ ID NO: 283277 - DNA, 4151 bp, Homo sapiens
agagagagagcggccagggggagatacgcaggcagaagggagcagaaggccaggccctctaaataaatcccttccttcctctctccaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttgtacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggccagcctgcaagggtaagacattcattctttgagttaaaggccatattcacttgatgatttctacacacactagaattgtgagagtgtccttgaaggagatcacaaagtaacctggtgactgtggcacagggtccgtggattccatctctcccaggcactgagggcgcagaggcgaaggagcaagccctgcatattggcagggctgtgaccatcgcacttagatcagacccccgacctgtgttgggatgtgagggatgccctcctgccccacccatccacatggttcctgggcagctctgttttattcctgtgtctttcctgatggatgagtattaagacagcatgtctggtttttaaacagacatttgggagcttgcacatcctgatgagcagggactcactgtggtggccttagggaattacacgctcactttggtggttctctatgctcggaagcctctgagagtggccttggcagcttaagatggcagaggctttggagtcttcttaggactgtaagtgcccattgaggatgcatttgagttttggaaagtaggcccaagtcaaatctgatggatggattcaagaacatggactaatctgcgttgtcatttttaatcaaaatgtaatggagattgatcatctggtggggttcacaaacttttcatgagagctgtgagttctttttttgagatgcacttttgcacttgttacccaggctgagtgcaatggcgcaatctcggctccactgcaacctccatctcccgagttcaagcgattctcctgcctcagcctcccgagtagctgagattgcaggcatgcgccaccacgcctggctaatttttgtattttagtagagatggggtttcaccatgttggccaggctagtctcgaactcctgatctcgggtgatccgcctgcctcggcctcccaaagtgctgggtttacaggcgtgagctactgtgccggccagagctatgagttctttcagaatcctcagatgccattagctagccactgtttggacatccttctcaccttgccctttggggtgatatccatacctacttgcttgcttctaacagtttttttatttgttttgtagagacgggttttggtttattgctcaggctggtttcaaactcctaggctcaagcggtcctcccactgtggcctcccaaagtgctgggtggtgtgagccaccgtgcctggccagttaattttttttagtgtctcttttttgggttctcaccagaaacactatcagcattcccacagatattcctgtgagtctttgaaacattttctatcctgcattgagtaagaataaaaccgaggaaggggtgaagcaccttgtctcatccccagtctggaacttgaaccttcttttctcttcactttgccctacccccaaataatatgtacaaatgtctgtatccattgagcactaactccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatctgaggtcaggattcgagaccaccctggccaacatggcaaaaccccatctctactaaaaatacaaaaattagctgggtgtggtggtgcgcgcctataatcccagctactcgggaggctgaggcaggagaatcttgaactcaggaggtggaggttgcagtgagccgagattgcgccactgcactccagcctgggtgacagagtgagattccgtctcaaaaaaaaaaaaaaacaaaaactcaga

SEQ ID NO: 283278 - DNA, 1458 bp, Homo sapiens
cgcacgttgaatcgcgtggtgactccgggcttgaggttggaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatgccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacatttccagccatggtgcacaggacagctggccagaaggactctgagcccctgggaattgaggaagctcagataggaaaacgaggatacttaacacccaccagtgcccgcgaacacctttctgccctgtggaagaatgaaggtgctgtatcaggctaaagaaatagccttgatcttctctaggcttttatttcctggactcattaaccctgccttattacttcttttaagttgtaatgattgtagcttcctcctggaactgatccagaggtttggggcagtcttcagggcacattgacattgagtcatagagcaggagaggtcatacccagcaccaaaaacttgacaattatcgcagctgagcctggttatgaaatgacaactgcaggtgggcctcacttaatacaggttggcatatttttagaaggttcagtgtaacttattttaaatgcccgtaagtaaaatgctttgtccttctgtgaatcaaagaatgaactctgtcttatttaaattgggactttactataagggaaatccttctttccttttgagtgtataacaaaacctacgcagtatattcaagcccttgtgagagtatgttgtggaacgctgactataacctctgtgtaataagcgcttacaaatgaacatgttgttaaagaggtatcagaaaaa

SEQ ID NO: 283279 - DNA, 368 bp, Homo sapiens
ctgcttcagattttgtttaaatataagaactggaaaaccaaagctttgtcatctctaaaacaccttcactgagaaacgaagtgtccttctcatcccatggggctgttctgggtatcaagtgactgtttagcttggccatttgctgctcctacctcaaatagaaggttggaatgcactgttgcacacatccgatttcaatttacaaaactggaattaaaccgtatgcaatgtaccttttaaaacttaacattatactaagtatattttgacacataattacacatcctttgaaactgcatataattccaccatagaggtgtatcataatttatgattggacattttgattaaaagccagcaatacaaac

SEQ ID NO: 283280 - DNA, 2369 bp, Homo sapiens
ccggctccgggcccggaggggtgcggcgggggcaggcggggaaggaccacgtgccttcggagagaggggttggaagcaatagagaagtagacttaaggggaaaccagcaaggggaaggagaggcccgggaacgcagcagggcgagttgttttgctccactcgtccaggaagccctagatgccgggggttcagggtcgaggctgcgttaaagtaacgttcttttctccccgggcgcgccctgtcttcctgggcattccttgcgctctccgttcgctttgcagagagatctgagcttcgctgtctcccggtcggacgctcgcagctgcgttcccgggctggggctccgtgccgtccagggccgggtctgggggccaggacctgctgggatgacgtgagttgaggaggctcagcggaaagcgacaggaaagtaagctctctgaagtcaagaaccatagttgttttgttcactactgtatactcagcacctaatagtacttggcacataagtactcagggactatttgtcaaatgcaagaacatatgcccctaaagcagaagtcaggaaaaccagaaaaaatgcctttaagtattacagaaatgccacaggcctccacttaaattgaaaagcaagctaacccctcttgataaaaatgtggattgagatcaagaagcagcttctctgctccttctggaatctccacctggtttagcctgctgcctccactcctgcctccaccatgtccatcagggtgatccagaagtcctacaaggtgtccacctttggcccccaggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggtttttttttggtccaaaataaaacctcagctagctccaccaaaaaaaaaaaaa

SEQ ID NO: 283281 - DNA, 1546 bp, Homo sapiens
ccggctccgggcccggaggggtgcggcgggggcaggcggggaaggaccacgtgccttcggagagaggggttggaagcaatagagaagtagacttaaggggaaaccagcaaggggaaggagaggcccgggaacgcagcagggcgagttgttttgctccactcgtccaggaagccctagatgccgggggttcagggtcgaggctgcgttaaagtaacgttcttttctccccgggcgcgccctgtcttcctgggcattccttgcgctctccgttcgctttgcagagagatctgagcttcgctgtctcccggtcggacgctcgcagctgcgttcccgggctggggctccgtgccgtccagggccgggtctgggggccaggacctgctgggatgacgtgagttgaggaggctcagcggaaagcgacaggaaaggtgggtggaaaaggaaagggcccattagacgaatctgattcatcttctgtgactaagcacccgcaacagttaggaatttaggcagagctggtgatcctgggacaatagcacttcctaggtaattcgtcttaaaaagttaaagaagctgcttgaccacaaagtatgaacttctggagggcggggcccgtggcagctgacagggaatattgtgtgttgagaaaggaaatgagttccaaggataccaaggacaacgttaccagaggcagaaatgacacgagatacaaaagaacgtattcaaaaatttaacaaaacagaaatggaaaattattttaaaatatattgaaatatcaacgaataacacctcaaatgtacagggatatgtaaagcagcaactcgggtcggaagcaaggaatcgaggcgttgggtgtgtttaaacttgacgaggtagggagaagagaccctgatacaaactccttcagaatcgttgactctcggtcctttctagtatatttttttagtagaacaacgtgcagataagtgtttaaaatgcagatcttcctaaggaaacacttttaaaggcaacagaggggaatttttttttaagttaaaatggaagaagttagtgggtttaacagatatgaacaactgagtttcctttgggggagaggcaatgaaaagagccggagtactttagggatcactttggagaggatattgtagtgggggaaaggaaggtaaaaacttaggaagcagagtagtacctttaaagtcgtcagtactttatataccatcaactgggctatggacaacagaagctgtgcctggaaataactcacactgaaggttaacttgaatataaatttagaacagatcttaaatacaaatgatgatgttcattataaactgttattcttcaaagactcatttaactgaagtaacattgtatttgcataccagagcactggtgtttttcaaaatgagtttaggataagaaaattcacttgaaaagctggagtatgtatgtattttgcgccatcatggattttatcataagcagtgttcaagaaaacaaattaccagcgaattcccaccctaaccccgaggttcgctgtacttcc

SEQ ID NO: 283282 - DNA, 2273 bp, Homo sapiens
cccccccgccctaaccccagcgcgactgcagctccggcaaagacaactgtggggccgggcggcggcaaggcgacggaatgtgctgccggctgagagggggaggcagcctcgatctgagggccaccggcgctgcggccacgcccatcgcctccagcccggctcgcccattggctaaccaggctccgagagatctgagcttcgctgtctcccggtcggacgctcgcagctgcgttcccgggctggggctccgtgccgtccagggccgggtctgggggccaggacctgctgggatgacgtgagttgaggaggctcagcggaaagcgacaggaaagtaagctctctgaagtcaagaaccatagttgttttgttcactactgtatactcagcacctaatagtacttggcacataagtactcagggactatttgtcaaatgcaagaacatatgcccctaaagcagaagtcaggaaaaccagaaaaaatgcctttaagtattacagaaatgccacaggcctccacttaaattgaaaagcaagctaacccctcttgataaaaatgtggattgagatcaagaagcagcttctctgctccttctggaatctccacctggtttagcctgctgcctccactcctgcctccaccatgtccatcagggtgatccagaagtcctacaaggtgtccacctttggcccccaggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggtttttttttggtccaaaataaaacctcagctagctccaccaaaaaaaaaaaaa

SEQ ID NO: 283283 - DNA, 1209 bp, Homo sapiens
gcggccgcgggtgctgccggggggcgcggcgggcgcagcagagcggcgggcggcggcggcgtcgtcgagcgcagacaatacaagcgcctcggaccgagtccccgaacctgccctagccaaaatggcggccgagaaagagcggaagtgacacagggtctcactctgttgtccaggcatgatcacagctcactgcagccttgacctcccagactcaagtgaacctcccacctcagcctcccaagtagctgggaccacaggaaatggacatatggaactcatcattcattttaaagtatggtggccattggcggtgacaaaaggaaaagaagcaaagagactcagtccataatgctgattagttagaagaaagggctaggattgagaaagtaccaggaacttttaattatttaaaagagaatgctgactgttaatgttttaaatcttactgttcaaatgtactaatatgaatttttaccctttgtgcatgaatattctaaacaactagaagacctccacaatttagcagttatgaaagttaaactttttattataaaaattctaaaccttactgctcctttaccaggaacatgacacactatttagcatcagttgcatacctcgccaatagtataattcaactgtcttgcccgaacaatcatctccatctggaagacgtagcctttagaaacacatttttctattaatttctctagaacttcttttcggtataatctgtaagaaattaaaaatatatatcaacttctggataaatacacatgcctatgtatcctgacctttcaaagagttcactggtatgtataaagcctaaaactttcactggccattggtaaacagaaaagctcgcacacttgatgattatgatacatttgtcctaagcaagaaaggccattaaatatttgctaaataacttagaataattgtgaaaatgaattctcagttatctttttatagaattattttcccaccatactatcagaaattagtgaaatacggtaaaatgaatcatttgatgcagaaccatccattatttaagatttccctaaaatttaaagttgaaagaaactgttccaaatattgaacaacagggtggacagatgatcatgaagcaactatatatgttagatgacaagaaagaacctcataattcacagtcattttccaataaatgtttatgatgaattttgattt

SEQ ID NO: 283284 - DNA, 412 bp, Homo sapiens
ctcctctcgctcctcagcagcggggaccgagagagggagctgtgtctgagaagacgccaaaatcccccttagcgctgcctgcgggagggggagggggcacaagatggcggcggccgggggggggggggcgggagttcagctcatggatcccggcgggcggcggaggggagaccgggccggcggaggcggcggcggcaacgggcgggggagggggctgatcccgcgtctcccctcagcagacaatacaagcgcctcggaccgagtccccgaacctgccctagccaaaatggcggccgagaaagagcggaagtgacgtaagtgcctcattagcataagaggactcattgtccagctaaataggggggggcagtggggacagcacccctaacccccttttccccagggggggttc

SEQ ID NO: 283285 - DNA, 473 bp, Homo sapiens
actattaaatgaggagagtcttccctaccctaagagctcactaacgagccctaaatattacagatcaccacctccttgctctgtaattcctggtcttctcttactaacaggaaatggacatatggaactcatcattcattttaaagtatggtggccattggcggtgacaaaaggaaaagaagcaaagagactcagtccataatgctgattagttagaagaaagggctaggattgagaaagtaccaggaacttttaattatttaaaagagaatgctgactgttaatgttttaaatcttactgttcaaatgtactaatatgaatttttaccctttgtgcatgaatattctaaacaactagaagacctccacaatttagcagttatgaaagttaaactttttattataaaaattctaaaccttactgctcctttaccaggaacatgacacactatttagcatcagttgcatacctc

SEQ ID NO: 283286 - DNA, 318 bp, Homo sapiens
atcccgcgtctcccctcagcagacaatacaagcgcctcggaccgagtccccgaacctgccctagccaaaatggcggccgagaaagagcggaagtgacgtaagtgcctcattagcataagaggactcattgtccagctaaataggggggggcagtggggacagcacccctaacccccttttccccagggggggttcctcttactcccacccctgcttgcacctaacttttcctgagggagggtgctctcagcacccccacccccgcttgagggaaattatataatccccactgaggggggagctctcgcgagaaccagg

SEQ ID NO: 283287 - DNA, 928 bp, Homo sapiens
gcggccgcgggtgctgccggggggcgcggcgggcgcagcagagcggcgggcggcggcggcgtcgtcgagcgcagacaatacaagcgcctcggaccgagtccccgaacctgccctagccaaaatggcggccgagaaagagcggaagtgacgttaaagaggcttttgtatactggagatataaccaaaaaaggtctaaggtgactttacgcagagattgaaggatgagcagcagatggtcatcaaggagcatggaaacagcatttcaggcaaaggaaaatggaactctgtgaactcagaagcatgctatggcatggaaagcaaaaaggaaggagcacaaggcagaggtcagaaagggaggcaggggccaacaaacacataggggcttgagggacaagggaaggaacttggatttttccctagatgttagtgggaactccctgaactccctgaactggagggacaataatctgattctgtttttatgtatctagcttaaactcagaacagcttccaaaatcttattcacagaggttttgtggtcttttgggctaagaatttaattatattgcctacaaacaaatataactgtgtatattttactaacatttaactaaattcttatcttactgtattaacatttccatgtttaatgatagctagcatgcctgtattaatgcatgtattggaaatgattcagcatttcactatttggtgtggtatttgtattaggactgggttatttttattatgcttaagaggtttccttctattcttaaagttttaactagaaaatggtagtaaataatatctcctttagcatctacagacttaaccacactactttgttaacataatgaatgaattataagtgattaccaataatgagccattctggcattcctggaataaacccttttgttcacggtgt

SEQ ID NO: 283288 - DNA, 1440 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283289 - DNA, 1424 bp, Homo sapiens
tgatgatgtcagcactgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283290 - DNA, 1638 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagaacttagtctcagtgttcctggagtgagagaagaggtgcaaggggcccaaagtcaggttgccatattcaggcgaactgcctgggaaggaggaatggtgcagagtcggcaatggtgtgacttcattctacaggaggttggttagcagtggacagttctagcttgtcttagatcaaaacttaaagctgcttgggctcaagc

SEQ ID NO: 283291 - DNA, 1995 bp, Homo sapiens
tgatgatgtcagcactgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggaggggtgagtgtttggaagtcagttaactagtcctcaagtttatgatcattgaaggacagcggtgtgcatatgcttggggcacaagggttttatccctatccctgtcctctctcacctgacagaacctagctacacagtatcaagaaggtggattctggagccaggcctgctaaatccacctcgtgtgaccttgataaaccatgtttttttcatcagcttaatggagatgattattatccctcactgatggagttgtgaggattaaatgagataatgtgtataaaatgtctcacccaatgcggggttgacaagtacttgataagtgttggctattatttatttagcatctgtcaagtgcagaggtctctattacgaccataggacctcaaagatttctatatctctgctcctgaggagctcacggtgtaatattcttcagatttctcttagagccacatcttgggaaggtttctgctaaatgggaaggacaccccactccccaccaggaaatttctctaggtccaagccatgtgggagatgaccatggccctttattgacccctttggcccacagtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283292 - DNA, 1379 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283293 - DNA, 1405 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283294 - DNA, 1567 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatcctctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagaacttagtctcagtgttcctggagtgagagaagaggtgcaaggggcccaaagtcaggttgccatattcaggcgaactgcctgggaaggaggaatggtgcagagtcggcaatggtgtgacttcattctacaggaggttggttagcagtggacagttctagcttgtcttagatcaaaacttaaagctgcttgggctcaagc

SEQ ID NO: 283295 - DNA, 1177 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccatccgcttatccgggtcctctagagtcagc

SEQ ID NO: 283296 - DNA, 1043 bp, Homo sapiens
aggcacgagaataaccaaggtcccggaatttttgggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283297 - DNA, 1690 bp, Homo sapiens
tgatgatgtcagcactgcttccggtcggtggcgcttctctctggcccgagccaggtcagtccggcagtgcagatggcccatcccgggctctgggctcctagaccggggtgggccctgccaggagtgggcctgagcctcgcacgtcctctgaaactacgctatgctctgcttttgcggcgcgatgggcgtgggagcgggggctgcccaaagatgggctggggttggaggaagtggcccggtagccgctgtgtgtcctgaggccgtaaggcgcctgaccccacccctgaagctggcgacggagcagggcctgttttctctacactatagtcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagacttgaagcccaccaatatattgcttggagatgaggggcagccagttttaatggacttgggttccatgaatcaagcatgcatccatgtggagggctcccgccaggctctgaccctgcaggtaaaagagtctccaggttccttttctcacctgttccccattcccaccccttctggtgcatgtcccagtttggtcacatgaccatgacctgtgccccacttttgagctctgggatcactgttccaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283298 - DNA, 977 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgtctcagtcctgcatcttttcttctgctttcttcctccaaatctgggagcaggagaatgtgtaaacaagaataaagtggaagcaggttggtgtagaacttagtctcagtgttcctggagtgagagaagaggtgcaaggggcccaaagtcaggttgccatattcaggcgaactgcctgggaaggaggaatggtgcagagtcggcaatggtgtgacttcattctacaggaggttggttagcagtggacagttctagcttgtcttagatcaaaacttaaagctgcttgggctcaagc

SEQ ID NO: 283299 - DNA, 668 bp, Homo sapiens
ggagatgattattatccctcactgatggagttgtgaggattaaatgagataatgtgtataaaatgtctcacccaatgcggggttgacaagtacttgataagtgttggctattatttatttagcatctgtcaagtgcagaggtctctattacgaccataggacctcaaagatttctatatctctgctcctgaggagctcacggtgtaatattcttcagatttctcttagagccacatcttgggaaggtttctgctaaatgggaaggacaccccactccccaccaggaaatttctctaggtccaagccatgtgggagatgaccatggccctttattgacccctttggcccacagtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaaggtcagaaagactcctggttatggagggggttgcagcagagccacctactcaagggctgtgtgagcagtccagcatgttaggaagcagggaccatgt

SEQ ID NO: 283300 - DNA, 1698 bp, Homo sapiens
tgatgatgtcagcactgcttccggtcggtggcgcttctctctggcccgagccaggtcagtccggcagtgcagatggcccatcccgggctctgggctcctagaccggggtgggccctgccaggagtgggcctgagcctcgcacgtcctctgaaactacgctatgctctgcttttgcggcgcgatgggcgtgggagcgggggctgcccaaagatgggctggggttggaggaagtggcccggtagccgctgtgtgtcctgaggccgtaaggcgcctgaccccacccctgaagctggcgacggagcagggcctgttttctctacactatagtcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283301 - DNA, 1566 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggtaaaagagtctccaggttccttttctcacctgttccccattcccaccccttctggtgcatgtcccagtttggtcacatgaccatgacctgtgccccacttttgagctctgggatcactgttccaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283302 - DNA, 1575 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggatttctcttagagccacatcttgggaaggtttctgctaaatgggaaggacaccccactccccaccaggaaatttctctaggtccaagccatgtgggagatgaccatggccctttattgacccctttggcccacagtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283303 - DNA, 1306 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283304 - DNA, 1138 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaaatttgcttatttggatacccaccaattcaattaggaccttttttacacttg

SEQ ID NO: 283305 - DNA, 1369 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatcctctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtaga

SEQ ID NO: 283306 - DNA, 1064 bp, Homo sapiens
aacgcgatccattcggctagtacgagccgcaggttaatcggcacgagggcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggattttttcacaatgggggggggttccggaatccaatgaagaaccggggacccgcataaagggggcttaaaatatcttttctccttgaggaaactgggagggcctgcaccc

SEQ ID NO: 283307 - DNA, 809 bp, Homo sapiens
catttactcttcctagtcatcagagggagattttgttgttatctccctctaaagatcacggaacttaggcacagaaaagtaattagtccaggtttgacgaataagtgactagtagatgctgaattcagatactggtagtctggcttctaactacttctctagttagatacttcaaaaaaagagaaagaaacagcctatattttatttaactcagcaaaaagtccttcttatttcatcattttgttcttacccctttttgtttgagttttagatactttctaggcatattcctgcaaatataatacctattaggggaactctgcatgatactaatgatgctcaatttttttctgttgacaggggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtga

SEQ ID NO: 283308 - DNA, 527 bp, Homo sapiens
ctaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtga

SEQ ID NO: 283309 - DNA, 783 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggtaaactcctccctcggcccctttaaaaaatctctgttttttctttattttttttctgtgtcttcctcttttgctgactttgatagcatcctggctctggactggtctttaagtatctagaagtgagtgtaggaggggtggctgggaaggtggaaaatagattctaagacccctaagcagattgtgcgaccctaatactggccctttgaatttactttctggtaaaaaagggactgggataagtgactattgggctctgggtcttttagaatttgacagagctttacaaatggaacatggtttctttagtggggctcttacttacacgtttggaactttctagacctggattagaaagcagggctctgctgactgagaattgttttagttcagtggtcttaaagctgagtacgggagaaagtacatacagggaaagaaa

SEQ ID NO: 283310 - DNA, 2132 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283311 - DNA, 2324 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283312 - DNA, 2698 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggttcgcttctccccatcactgcccctttacaccatcctctacatgttatttaatgaaaaaccacttgaaagggttaccaaggataagatttttaaagcttgctttcacaaacaactcatgctccaggcttgtcagtggcatgcttccagtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283313 - DNA, 2620 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggttcgcttctccccatcactgcccctttacaccatcctctacatgttatttaatgaaaaaccacttgaaagggttaccaaggataagatttttaaagcttgctttcacaaacaactcatgctccaggcttgtcagtggcatgcttccagtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283314 - DNA, 2314 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283315 - DNA, 1778 bp, Homo sapiens
aaatttttgatttttgtttaagcaagtaaagactcaatttttctgttattagcataatgaaatgggtagtaaatcatgtttcctcttggtctttgtcagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283316 - DNA, 2030 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283317 - DNA, 1607 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgag

SEQ ID NO: 283318 - DNA, 1429 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttata

SEQ ID NO: 283319 - DNA, 939 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagta

SEQ ID NO: 283320 - DNA, 499 bp, Homo sapiens
cactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattc

SEQ ID NO: 283321 - DNA, 932 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcgggccgctggaccccgttgctaaggacccttgagatcgtgagcgcttggagtgtacccctcctttcctggggtagagggtcagtcgagagtagccttcgttaaccttaattgaaactgtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgaggtaaatatgccatctcttgaatatttatcagaaaataaacattaaaaattgcattaaatgctactttgtagct

SEQ ID NO: 283322 - DNA, 2213 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283323 - DNA, 2252 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283324 - DNA, 2243 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283325 - DNA, 1226 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtga

SEQ ID NO: 283326 - DNA, 2198 bp, Homo sapiens
tctggtactggtcccggaatccttatgatggcgctcggtggcggtagccgcggttgttggccgaccgagtgccggtcataagccccccccggtggggggcagctggtgtgcggatcgcggcgggagagaggcgcgtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgttttggtatcagcatgatgctggcctcataaaatgagttagggaggattccctctttttctattgattggaatagtttcagaagaatggtacaagctcctccttgtacctctggtggaattcagctgtgaatccatctggtcctggactttttttggttggggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgcattcattgattttgttgtgcttatgtttagcaatttttaagaagcttttaaaatataatatagacatagttcagaattttgatgtaatagaagcaattccctctggctacaacagctgcctgcctgctggccttgcttttacctgttttcattgcattgagcaccatccagagctatctgccatctagaaagtactgtaagatttaattaattacaaaatttcttggaaaagacctgtaacatagacagtagagttataaacattttattttgcttttatttt

SEQ ID NO: 283327 - DNA, 1122 bp, Homo sapiens
ccaggttcaggggcgggccgcgcggagctcattttccccaaacgcaggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagta

SEQ ID NO: 283328 - DNA, 799 bp, Homo sapiens
aggcaaggagcatctcattcattcacagacaagactgagctgggccaaaggtctctgtactggatctcatcttctgtcttccaatccacatccttttgggcatgagcagaaagactgagtctcactctgtcgtccaggctggagtgtagtggtacaacctccacctcctgggttcaagtgattctcctgcctcagcctcccaagtatgtgggactacaggtgtgcactaccaggcccggctaattttttttttgtatttttagtagatactaggttttgccatgctggttgggctggtctcgaactcctgacctcaagtgatctgcctgcctcgaccccccaaagtgctgggattataggtgtgagccaccatggctggcctgaacttcagattttttatctgtaaggaggggttaggaggcctaaattaagtcacccataaaaaggccatgtcacatgcagtcagtgcttagcaaggggctattttaatcgtcacactcaccagtcagagacacaaatctcaatcctgccactatccagcagttctggccacagaccctcctcctctaggtccaagacctgcttcttgcaacaccagctgggaatgcaggagacagggtaatgagaacaggcaggcctttctcaacaaggggccggacctttggatagcaggggcattcacctgaatgaagtcacgaagcacgtttgagaaggggccccaggcacggttgtcctgttttcctccaccacccagccgtccccaacgtgttgcaccatccactttcggaggccttctgtg

SEQ ID NO: 283329 - DNA, 1785 bp, Homo sapiens
acttgcgctgtcactcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagatcaagtcggacaagcagcagctgggcagcgtcatctacagcatccagggacccggcgtggatgaggagccccggggcgtcttctctatcgacaagttcacagggaaggtcttcctcaatgccatgctggaccgcgagaagactgatcgcttcaggctaagagcgtttgccctggacctgggaggatccaccctggaggaccccacggacctggagattgtagttgtggatcagaatgacaaccggccagccttcctgcaggaggcgttcactggccgcgtgctggagggtgcagtcccaggcacctatgtgaccagggcagaggccacagatgccgacgaccccgagacggacaacgcagcgctgcggttctccatcctgcagcagggcagccccgagctcttcagcatcgacgagctcacaggagagatccgcacagtgcaagtggggctggaccgcgaggtggtcgcggtgtacaatctgaccctgcaggtggcggacatgtctggagacggcctcacagccactgcctcagccatcatcacccttgatgacatcaatgacaatgcccccgagttcaccagggatgagttcttcatggaggccatagaggccgtcagcggagtggatgtgggacgcctggaagtggaggacagggacctgccaggctccccaaactgggtggccaggttcaccatcctggaaggcgaccccgatgggcagttcaccatccgcacggaccccaagaccaacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagcaaaccagccaggctctctggcggcagggtgagactgcccccagggccttcattcagtgagccggtccgattcgcggatgggtcaccggtagtggcagcgccgggcggacaagccaggtgcggtaactggctggaaggacgccagaacttagagggggagaagttgtccgcgactgggggcgcatggatgcctggtctcgggggggccacaagaaagagcgcgccc

SEQ ID NO: 283330 - DNA, 2859 bp, Homo sapiens
acttgcgctgtcactcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagatcaagtcggacaagcagcagctgggcagcgtcatctacagcatccagggacccggcgtggatgaggagccccggggcgtcttctctatcgacaagttcacagggaaggtcttcctcaatgccatgctggaccgcgagaagactgatcgcttcaggctaagagcgtttgccctggacctgggaggatccaccctggaggaccccacggacctggagattgtagttgtggatcagaatgacaaccggccagccttcctgcaggaggcgttcactggccgcgtgctggagggtgcagtcccaggcacctatgtgaccagggcagaggccacagatgccgacgaccccgagacggacaacgcagcgctgcggttctccatcctgcagcagggcagccccgagctcttcagcatcgacgagctcacaggagagatccgcacagtgcaagtggggctggaccgcgaggtggtcgcggtgtacaatctgaccctgcaggtggcggacatgtctggagacggcctcacagccactgcctcagccatcatcacccttgatgacatcaatgacaatgcccccgagttcaccagggatgagttcttcatggaggccatagaggccgtcagcggagtggatgtgggacgcctggaagtggaggacagggacctgccaggctccccaaactgggtggccaggttcaccatcctggaaggcgaccccgatgggcagttcaccatccgcacggaccccaagaccaacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgtgccgctgcggcaaggacggcgtctgcctgccgggggccgcagcgctgctggcggggggcacaggcctcagcctgggcgcactggtcatcgtgctggccagcgccctcctgctgctggtgctggtcctgctcgtggcactccgggcgcggttctggaagcagtctcggggcaaggggctgctgcacggcccccaggacgaccttcgagacaatgtcctcaactacgatgagcaaggaggcggggaggaggaccaggacgcctacgacatcagccagctgcgtcacccgacagcgctgagcctgcctctgggaccgccgccacttcgcagagatgccccgcagggccgcctgcacccccagccaccccgagtgctgcccaccagccccctggacatcgccgacttcatcaatgatggcttggaggctgcagatagtgaccccagtgtgccgccttacgacacagccctcatctatgactacgagggtgacggctcggtggcggggacgctgagctccatcctgtccagccagggcgatgaggaccaggactacgactacctcagagactgggggccccgcttcgcccggctggcagacatgtatgggcacccgtgcgggttggagtacggggccagatgggaccaccaggccagggagggtctttctcctggggcactgctacccagacacagaggccggacagcctgaccctggggcgcaactggacatgccactccccggcctcgtggcagtgatggcccctgcagaggcagcctgaggtcaccgggcccgacccccctgggcctggggcagcctccttcctgtaggcgagggcccaagtctgggggcagaacctgagtgtggatggggcggccaggaagaggccccttcctgccggggtgggaagagtttctctccatcggccccatgcgggtcacctccctagtcccacctttgcctcctaccagtgaacctcatctttgtatgaaagacagcaacctcctgggtaaatctgaatgaaaaacgtgctagtctctttcatgca

SEQ ID NO: 283331 - DNA, 899 bp, Homo sapiens
gcgcattagctgcccgcctcaccccagtcgtccaatctcaaagcaccgggatccacctttgccataacaaaaggacactgacatccaatcaggattgaggtcgctgtgggcgggacctggaacagcgacagccaatgacagtaaagaagcgaagctaagcggcgctggtgaagcggctcatcaggtctatcaggaaacctgagaattggagtgagaatcccagtgtggaaaatcaggaaagaggctggtatgagcgacagagaagtcattcaggaaagaggttattgaattcattggagaatgaatgctgttctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatagaaacctcctgtacttcatttcttaaatcccttgagggtagtaactgcatcttctccattgatatagcccctgccaagcacagtgcctgaaggcaggtccacagacattggctgaataaacgagtgctctgttcccagtccgtactttctctgtgtcataaaaaagctgacatgtctgtgctgcatttgaggatgacactggatttccacattgccttttcgcctcagagcttatattacttcctatcaagttatctctctgcccctcatcgcatcccagtgagaaagcagaaaatcctagaaagtcattttccttactgttccggtggtggctcttcacgcttacagaacgttaggtacactgggaacatcacctagagggacactgacatcacctcatcataacatatgtctctga

SEQ ID NO: 283332 - DNA, 482 bp, Homo sapiens
gcgcattagctgcccgcctcaccccagtcgtccaatctcaaagcaccgggatccacctttgccataacaaaaggacactgacatccaatcaggattgaggtcgctgtgggcgggacctggaacagcgacagccaatgacagtaaagaagcgaagctaagcggcgctggtgaagcggctcatcaggtctatcaggaaacctgagaattggagtgagaatcccagtgtggaaaatcaggaaagaggctggtatgagcgacagagaagtcattcaggaaagaggttattgaattcattggagaatgaatgctgttctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatag

SEQ ID NO: 283333 - DNA, 251 bp, Homo sapiens
caatatcgcttgttagtaacataaataccagaaccgaaggcacttttggggtaacgaattcattggattatgaatgctgctctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatag

SEQ ID NO: 283334 - DNA, 784 bp, Homo sapiens
gcgcattagctgcccgcctcaccccagtcgtccaatctcaaagcaccgggatccacctttgccataacaaaaggacactgacatccaatcaggattgaggtcgctgtgggcgggacctggaacagcgacagccaatgacagtaaagaagcgaagctaagcggcgctggtgaagcggctcatcaggtctatcaggaaacctgagaattggagtgagaatcccagtgtggaaaatcaggaaagaggctggtatgagcgacagagaagtcattcaggaaagaggttattgaattcattggagaatgaatgctgttctgaatttggtagagggaatgtaagaaattaccaatgtacttttagagttttttcaagcaagaattccaaaggatttcaaggtctttatggaatcaagctttggactttatcataaaaatggaaataattaggaatgattctgtgcagtctcggtgctgtgaaaggagaataaaaacgtgagactccagttcactctgccagaaggaaaaaaataagctgaaagctgagtcatgcaagaagctgccttttcttctgttcctaagcagatagctacagataaaaggttaaatatctccataggtagctactctatgttcaccctatttcatgtaaagtgctgatttgctgcacacaagatgaatgcatcattcaccattcccctacctgcgccttttctcctgcaacttagattactataccctcgctcttacctctccaacccacttttcccctttaaatactgaagctctc

SEQ ID NO: 283335 - DNA, 591 bp, Homo sapiens
gcgcattagctgcccgcctcaccccagtcgtccaatctcaaagcaccgggatccacctttgccataacaaaaggacactgacatccaatcaggattgaggtcgctgtgggcgggacctggaacagcgacagccaatgacagtaaagaagcgaagctaagcggcgctggtgaagcggctcatcaggtctatcaggaaacctgagaattggagtgagaatcccagtgtggaaaatcaggaaagaggctggtatgagcgacagagaagtcattcaggaaagaggttattgaattcattggagaatgaatgctgttctgaatttgtatcctaagggaaataccacaaaatgtctcagaaaatgttggttggatatctaaagtttaaaaaggaagagaaccacaccagctggagattaaagaagcatcagtagaatatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatag

SEQ ID NO: 283336 - DNA, 241 bp, Homo sapiens
  misc_feature (40)..(40): n is a, c, g, or t
  misc_feature (43)..(43): n is a, c, g, or t
cgccccccccctgcccggaagcaaaagcgccccttcaggntanctgaattcattggattatgaatgctgctctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatag

SEQ ID NO: 283337 - DNA, 240 bp, Homo sapiens
  misc_feature (31)..(31): n is a, c, g, or t
aatgtaaagtttaaagacaggaagaaccccnttttcaggttactgaattcattggattatgaatgctgctctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatag

SEQ ID NO: 283338 - DNA, 212 bp, Homo sapiens
  misc_feature (20)..(20): n is a, c, g, or t
cacggtgttccgagttttgnaatcttgggataagaatgctgttctgatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatag

SEQ ID NO: 283339 - DNA, 623 bp, Homo sapiens
gcgcattagctgcccgcctcaccccagtcgtccaatctcaaagcaccgggatccacctttgccataacaaaaggacactgacatccaatcaggattgaggtcgctgtgggcgggacctggaacagcgacagccaatgacagtaaagaagcgaagctaagcggcgctggtgaagcggctcatcaggtctatcaggaaacctgagaattggagtgagaatcccagtgtggaaaatcaggaaagaggctggtatgagcgacagagaagtcattcaggaaagaggttattgaattcattggagaatgaatgctgttctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatagaaacctcctgtacttcatttcttaaatcccttgagggtagtaactgcatcttctccattgatataaactagcccccatctcaatcataccccaaatctctccctcactaaacgtaagccttctcctcactctctcaatctt

SEQ ID NO: 283340 - DNA, 1769 bp, Homo sapiens
agcaaatgatcttaaaatttatagtttgccattaatttttacttttaatgcagctggatctagcatggggtgggacatgcttccgaagtaagctggtataaatctatcagataacctgtctcttatgtttcaaagttaaatattaaattcatatattgtggtcttcaaaaggtattgctaggacattttaaaatgaattttgactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaacacatttagaatagtgcaattcgccatatatgacatctcagcatcttctgcttttcctggactccaaaattaaattgcagttcttgaaaatgtatgtatgccctttgttacagcaacagtagccttctgtcacaggggttatcttgcctaaaagatggataagaaagatgtatttatcaccaacacattcttcagctagattgcatcttgtcctatatatatagccataagtggattcctatatatagctattgatagactcctaggtaattacatgggatatgagttagatccagtctgacttggttttgttttgttcttttttttccccccggaatacaggacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283341 - DNA, 1790 bp, Homo sapiens
caggctgtaccggtcgcgagtgttagggataggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283342 - DNA, 2997 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtgagagatgggtgggaatggttaaaagattccatttagttcccttgaaagagacccatgcttcataaaagtggctagagccacctgtgctctccggacagtatccaaaaggtgcaaattacatgttagtcttcaatatttctctagcttaggccacaagttccatttggcctgtcaaggtgttagtgtatgactccaaccaacttgttccttctgagagaacaacaaattcagtttgttagtgagaacattctttaatcagttgtaagcatatttgggttacagaaaaacatttgagagatctaacatttgttatgtgccctctgtatatcatctacacgataagactgaaatattttattcttttacagagaagggaactaaagctcagagaggttaagtactttgcccaaagtcatttgataaatgaaaggtagaaccagaattcaaatttggacctgtctgataccaaaacccatactcgctctactacagaagtactgtagtggtaagctgaagggtacaggttcaggggttagtaatgaatatcacagtgagaattttaactattactttaggcttatagtttgctaataaaattgctacctgaaggcagaggcagtggcttaaaattttattttataaaataagttttttgaggaggttttgcctcatttgcccaaggctggaagtgcacctttggactccacctagtgtcgacccttgcaagtgctgcgcaga

SEQ ID NO: 283343 - DNA, 2788 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283344 - DNA, 2710 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttcttaacacttaagttactcttctgaaattgctaggaccattgggggttttggtggtctgctcggctcttacctccgcacctcgaccgcgcgctccccttaccttact

SEQ ID NO: 283345 - DNA, 2151 bp, Homo sapiens
gattcctagatggtaacccgcttgtagtgtttgcaggttcacactattgaatgactcttggatgcggcctgtctcctagcagttggaggtataaagcctgagcacttttgtttctgctagaaactggagtgataggactctttgacattgggcagaaggaatttgactaaagtgatattgccacactaacccgctcccctctcaggatcagtgcatggcactgttctggctgccgtcctcaatagggctatttccaacaggatggtggagcacaaggcttcctctcgcatagctgcatccagaagaaggtctgttaaagagagagcaacttgctgattgcagaggggggatttgttctcagcagtccttaagagtaatgagaagccctgttctttttatctgtactgactgcgttttccatttttttttttttttaaaggaggttgctgaaatagggtcacaggtgtgtgcgtctatgtgtcttatgacaactaatttactttcatttggggaggagaggaaaaagaatgtcaagtgagttaaaataaatcttcttacatctgttccctcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtgagagatgggtgggaatggttaaaagattccatttagttcccttgaaagagacccatgcttcataaaagtggctagagccacctgtgctctccggacagtatccaaaaggtgcaaattacatgttagtcttcaatatttctctagcttaggccacaagttccatttggcctgtcaaggtgttagtgtatgactccaaccaacttgttccttctgagagaacaacaaattcagtttgttagtgagaacattctttaatcagttgtaagcatatttgggttacagaaaaacatttgagagatctaacatttgttatgtgccctctgtatatcatctacacgataagactgaaatattttattcttttacagagaagggaactaaagctcagagaggttaagtactttgcccaaagtcatttgataaatgaaaggtagaaccagaattcaaatttggacctgtctgataccaaaacccatactcgctctactacagaagtactgtagtggtaagctgaagggtacaggttcaggggttagtaatgaatatcacagtgagaattttaactattactttaggcttatagtttgctaataaaattgctacctgaaggcagaggcagtggctcactcctgtaatcctaacactgggaggctgaggcgggaggatcacttgagcccaggagttcaagaccagcctaggcaacatagcaagaccctgtctctacaaagaaaattaaattagcagggtgtgatggggagcacctgtgatcccagctactcagaatgctgaggttggaaggattgcttgagcccaggagttaaaagaggctgcagtgagctatgatcacaccactgtattccagcctgggcaacagagtgagactgtctctcctttattt

SEQ ID NO: 283346 - DNA, 1690 bp, Homo sapiens
  misc_feature (12)..(12): n is a, c, g, or t
  misc_feature (105)..(105): n is a, c, g, or t
  misc_feature (112)..(112): n is a, c, g, or t
cgcactcgatcncaggggctctgggggggcatcttggctgcaagaaatgcggagcctggctccctgtcagtaagagcacgccaaaggtcagcaccgcagccatcntgaaggnccgtgggggacctccctcgtgccgaattcggcacgagctagtctcttatgtttcagagaaaatgaagactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaacacatttagaatagtgcaattcgccatatatgacatctcagcatcttctgcttttcctggactccaaaattaaattgcagttcttgaaaatgtatgtatgccctttgttacagcaacagtagccttctgtcacaggggttatcttgccatcttgtcctatatatatagccataagtggattcctatatatagctattgatagactcctaggtaattacatgggatatgagttagatccagtctgacttggttttgttttgttcttttttttccccccggaatacaggacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283347 - DNA, 2319 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggtgaactgctctgggcctgggtagtagcgccgagtggggtctagctcaaaacaggcaagaacacaagactatagaacttgctgggtggtctcttccattctgttttagctggaaataatagattatgtttaccgctcttaagcataatttacccctggggaagcaaacacttccccttttcaggtttgctaagatgttgctcaccgactgcatagaatcacaaactgtgggttactttaccctgcgggattcttgcattgattcgagtgctgttggaagtgtaatctgcttggggaaacgagtacctcatgagagaagggaggataaaggtccgtggcttacctgcttctttggtgatgatcaggaagccttatatttgagggtttaagtgcttaagatttatattctttactgctttgggtggatactggtgggaaagaagaaaaaagacatctagaggaagccctatattataaatctgggtggcaagtctggatctgcgggagtatctttttgttgatcaaagttgtgcagtctcttcaagcagagtcaaaaaaacatgccatggagtgttctgctccacctgttcatttcaccctcagaaaaggaaatttctaaatatatcagactcaatgggaatgatggtcccgcttctgaagaaatttcagtacaagcatcgtagagcatatcatactatttataccgataataaaggtacatatgttgtcattaataccaca

SEQ ID NO: 283348 - DNA, 1846 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagattcgctcactcttcgagcagtatgggaaggtgctggaatgtgacatcattaagaattacggcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283349 - DNA, 1294 bp, Homo sapiens
  misc_feature (12)..(12): n is a, c, g, or t
  misc_feature (105)..(105): n is a, c, g, or t
  misc_feature (112)..(112): n is a, c, g, or t
cgcactcgatcncaggggctctgggggggcatcttggctgcaagaaatgcggagcctggctccctgtcagtaagagcacgccaaaggtcagcaccgcagccatcntgaaggnccgtgggggacctccctcgtgccgaattcggcacgagctagtctcttatgtttcagagaaaatgaagactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaacacatttagaatagtgcaattcgccatatatgacatctcagcatcttctgcttttcctggactccaaaattaaattgcagttcttgaaaatgtatgtatgccctttgttacagcaacagtagccttctgtcacaggggttatcttgccctctgtagttccagctacttggaaggttgagatgggaagaccgcttcagctcagaaggttgaggctgcattgagccatactcataccactgtactccagagaaatccctcacccttcctgccttgcaaactcaagacagaatccagacaccacgtctgccacggccttgatctcagctttcccagcctccgaaactgtgagaaataaaattctgttgtgtataagccatccagtcttacggtcttttgttacagcacctcaaacggactaaaaaaatcctcctgttggcggggcatggtggctcacacctgtaatcccatctgcttgggaggctgagggagaagaattgttgaagctgggaggagaggttgcagtgagctgagattggcattgaacggatagtgccggg

SEQ ID NO: 283350 - DNA, 1230 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggtgcgagggggtcgtgtgtgtgtgatgtggggagctcggggcggtcgggccgggcctccggcagactgcacggcc

SEQ ID NO: 283351 - DNA, 2841 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283352 - DNA, 3157 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtgagagatgggtgggaatggttaaaagattccatttagttcccttgaaagagacccatgcttcataaaagtggctagagccacctgtgctctccggacagtatccaaaaggtgcaaattacatgttagtcttcaatatttctctagcttaggccacaagttccatttggcctgtcaaggtgttagtgtatgactccaaccaacttgttccttctgagagaacaacaaattcagtttgttagtgagaacattctttaatcagttgtaagcatatttgggttacagaaaaacatttgagagatctaacatttgttatgtgccctctgtatatcatctacacgataagactgaaatattttattcttttacagagaagggaactaaagctcagagaggttaagtactttgcccaaagtcatttgataaatgaaaggtagaaccagaattcaaatttggacctgtctgataccaaaacccatactcgctctactacagaagtactgtagtggtaagctgaagggtacaggttcaggggttagtaatgaatatcacagtgagaattttaactattactttaggcttatagtttgctaataaaattgctacctgaaggcagaggcagtggctcactcctgtaatcctaacactgggaggctgaggcgggaggatcacttgagcccaggagttcaagaccagcctaggcaacatagcaagaccctgtctctacaaagaaaattaaattagcagggtgtgatggggagcacctgtgatcccagctactcagaatgctgaggttggaaggattgcttgagcccaggagttaaaagaggctgcagtgagctatgatcacaccactgtattccagcctgggcaacagagtgagactgtctctcctttattt

SEQ ID NO: 283353 - DNA, 2574 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
  misc_feature (2574)..(2574): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtgagagatgggtgggaatggttaaaagattccatttagttcccttgaaagagacccatgcttcataaaagtggctagagccacctgtgctctccggacagtatccaaaaggtgcaaattacatgttagtcttcaatatttctctagcttaggccacaagttccatttggcctgtcaaggtgttagtgtatgactccaaccaacttgttccttctgagagaacaacaaattcagtttgttagtgagaacattctttaatcagttgtaagcatatttgggttacaggcaagtcaggaatttggcaatgacgaacagggn

SEQ ID NO: 283354 - DNA, 2164 bp, Homo sapiens
  misc_feature (651)..(651): n is a, c, g, or t
  misc_feature (681)..(681): n is a, c, g, or t
  misc_feature (722)..(722): n is a, c, g, or t
  misc_feature (863)..(863): n is a, c, g, or t
  misc_feature (923)..(924): n is a, c, g, or t
  misc_feature (1022)..(1022): n is a, c, g, or t
  misc_feature (1025)..(1025): n is a, c, g, or t
  misc_feature (1029)..(1029): n is a, c, g, or t
  misc_feature (1033)..(1037): n is a, c, g, or t
  misc_feature (1042)..(1042): n is a, c, g, or t
gcaagctccgcctcccgggttcacgccattctcctgcctcagcctcccaagtagctgggactacaggcgcccgccactacgcccggctaatttttgtatttttagtagagacggggtttcaccgttttagccgggatggtctcgatctcctgacctcgtgatccgcccgcctcggcctcccaaagtgctgggattacaggcgtgagccaccgcgcccggcacgcctaagcttgtttttaccgccaggaggtgcccttggaccacagctgaattttgaatgctagacagtcgggaaactcagttgcctagacttccagcttggtgtgtacgaggagaccctgtcccacccagaactagggacctcgctgggcctctccaccaagtattcctctggcgtgctcaccacagaccaggactgtgatggacacacaatgagtgagagagaatcagaccacggatactcacgagcaaacaaaacatgactaagcgtagcctgggtagcaatgcctcttaggcctgtcccagttctgccaggttatctttctgccccttggttctcagtttccgtagcaataaataacacctctgcaatgacaaactttaaaataatgtttaaagcgctacaaaacaatgactagttttgcttaaaangtggcgcacctgtatttttgaaatgtgccncaagctgccacagaaccggccagcccgctacaaaagccccnttttagggccctcggggagattcctctgtcattagctccccgcccccctcaaagggcccaagagcaggacccattgtggtgagcgactccccaaggcctccgcttttctaggcagtggttgcgttcagagcccctctgacncagcatggcgaccctttccaggtggtgactggctggctgggctgggggtggctgacctcnnggcccgcgccaccaccacagccccgcccccgtgctgcgtggtcatttgtatgcagcctcgggattggtcactcggctcccgcgaggggaaggggaggnaancagngcgnnnnngcgcntgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283355 - DNA, 1746 bp, Homo sapiens
  misc_feature (12)..(12): n is a, c, g, or t
  misc_feature (105)..(105): n is a, c, g, or t
  misc_feature (112)..(112): n is a, c, g, or t
cgcactcgatcncaggggctctgggggggcatcttggctgcaagaaatgcggagcctggctccctgtcagtaagagcacgccaaaggtcagcaccgcagccatcntgaaggnccgtgggggacctccctcgtgccgaattcggcacgagctagtctcttatgtttcagagaaaatgaagactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaacacatttagaatagtgcaattcgccatatatgacatctcagcatcttctgcttttcctggactccaaaattaaattgcagttcttgaaaatgtatgtatgccctttgttacagcaacagtagccttctgtcacaggggttatcttgcctaaaagatggataagaaagatgtatttatcaccaacacattcttcagctagattgcatcttgtcctatatatatagccataagtggattcctatatatagctattgatagactcctaggtaattacatgggatatgagttagatccagtctgacttggttttgttttgttcttttttttccccccggaatacaggacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283356 - DNA, 1135 bp, Homo sapiens
  misc_feature (12)..(12): n is a, c, g, or t
  misc_feature (105)..(105): n is a, c, g, or t
  misc_feature (112)..(112): n is a, c, g, or t
cgcactcgatcncaggggctctgggggggcatcttggctgcaagaaatgcggagcctggctccctgtcagtaagagcacgccaaaggtcagcaccgcagccatcntgaaggnccgtgggggacctccctcgtgccgaattcggcacgagctagtctcttatgtttcagagaaaatgaagactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaaaaac

SEQ ID NO: 283357 - DNA, 1491 bp, Homo sapiens
  misc_feature (12)..(12): n is a, c, g, or t
  misc_feature (105)..(105): n is a, c, g, or t
  misc_feature (112)..(112): n is a, c, g, or t
cgcactcgatcncaggggctctgggggggcatcttggctgcaagaaatgcggagcctggctccctgtcagtaagagcacgccaaaggtcagcaccgcagccatcntgaaggnccgtgggggacctccctcgtgccgaattcggcacgagctagtctcttatgtttcagagaaaatgaagactgcaagcagtggttgttcaactaacctctttttagcgatgacttttaaagaaacttaccttccaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtgagttaactttttttttcccccagccattggtgtctggagttcccatcatcaatagaaggattagagaattctaggaatgatttcttttgatttggcaagggagatttggtcaattaggggaactactggaactgtggctctcactctgtgacagtgtgacatgtaggtgtgttggaattgggtgaatgactggctgctccttgatatcctaccccttgtgaccatcatttctgaaagcttgtttactgtgaaagattaaaacaaaacacatttagaatagtgcaattcgccatatatgacatctcagcatcttctgcttttcctggactccaaaattaaattgcagttcttgaaaatgtatgtatgccctttgttacagcaacagtagccttctgtcacaggggttatcttgcctaaaagatggataagaaagatgtatttatcaccaacacattcttcagctagattgcatcttgtcctatatatatagccataagtggattcctatatatagctattgatagactcctaggtaattacatgggatatgagttagatccagtctgacttggttttgttttgttcttttttttccccccggaatacaggacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttctagtaacccccctatcttctagtaacccggaccgagcgtc

SEQ ID NO: 283358 - DNA, 458 bp, Homo sapiens
aaagtcatgcacagtttcactcaagtgtctgactccagatccgcttgcctctaatctctcatagtaacttgttgacacattttctccagttgtcctgtcttgcttaaaaagctgtggggaagactcagcctggctcaggtagtattagaccagcagtccctggtgtggcatactcagttttggcattgccttcctggtatgttttaaagaaaactcatcagaacctttgtatcttttttattttctccagcctgggtgactgagactccgtttcaaaaaaaaaaaaaaaaagaaataatcagttcataagtcttaaattacatggttttgcagtgcttgtgttcatgtcacccttatatttaataatggccccaaagcaaaagatgctggcaatttggatattgtaaagagaagctgtaaagtgtttccttttactgaaaaggtgaaagatctcaatt

SEQ ID NO: 283359 - DNA, 862 bp, Homo sapiens
agtctcactcgcccaggctggagtacagtggcacgatctcggcttactgcagtggccgcctcccagttcaagtcattctcctgcttcagccccccgagcagcttggattacagccagccacatccagaaggaggaagtgagacgtacctggtgattgttgctggcagccgacgaactggcctgagctgtgctggctgagagagaatcaaggaaggcttggtcagccactgaatttccacaagaaaattgatcttttccatcactgggtaaaatctgaataggagaaagagccgcaattattttcatagattacggtcacttcagggagtcttcgagggcaagcaagaattgtcaaaaagggtttatattcttcaatgctacaaatttctcttgtgattccattgtggtctcagggcagacactgtatgatttctttcaaacatgttgagagaacaccgttcaaaatcttaaattcttaagccttctctttacttcagaaaatgatgtaacctaaaaacaagaaaaatcaaacttcaataataagtgatcaaagattgaaaacagctgatgattagatgaccctcatcttgtctgtgtactggtctgcggcagataataaaagtggcttgcagctctgaatgtgaagcggtgggatgcgcatcccaggcctggaatctgccctctgccacctcgctggtcaacagaatcaagtggaaatcctccagggaatccagaaccttgcctcaagggcttctgcacacttcagctgactcttctggcacccaagtcgctatacgaattaatgtgggttgctagatgatgacagagacccagtctccctgttgccccattcaaagccagc

SEQ ID NO: 283360 - DNA, 450 bp, Homo sapiens
tagttcaaactattttttaatttctcgagatttcttctttgatccatgcattatttagaagtggattgttcaatctctaagtatttacagattttccatctatctttctgttttgatttctagtgtgattccattgtggtctcagggcagacactgtatgatttctttcaaacatgttgaggtatgttttatggctcagaatatgtggtctgtcttagagaatgttccatgtaagcttgaaaagaatgtgtatgctgctgtggtttgatgaagcagtctatagatgtccctaagtggacatcaatttattgatggtgctgagttcaaccacgtccttactgattttctgcctgcaggatctatttctaatagagggggttttatattcttaaaggtaagcaaacccaagaatatctgtaatcactattcctttatataagcagaatccta

SEQ ID NO: 283361 - DNA, 367 bp, Homo sapiens
caactgacagactaaacttcccttgcacttcatctattaccgacagatatagtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggtaaggatttcaaatttcgacattttcccaaagtctttatttatgccactctgcatgccttcatggagcgatctttgagagtccgtgctgtatggcaaatttaggattaaatcacatgagtgaagcccttcatttattggaagagaaataaagcaaaatctttacaatggttact

SEQ ID NO: 283362 - DNA, 1544 bp, Homo sapiens
ccccttccagtccctgctccttcaatagacagaagcacgaaacctcctctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcaaagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaat

SEQ ID NO: 283363 - DNA, 1829 bp, Homo sapiens
ttcccccccccccccccctctaacgacgccatgatcgagctcgtacccggggttgttggttagattaccgaagaagactaaattcatgtgtaacagtgcagattatttaattgtatcacaaaatgtaaaattgcatgcatggtttgatggaaacatttctcacatttatgtcttctaacacacgtgggtaaagaatcagtaactgccaatgaatgagatagcataaaattttgactttcataaaacaaaacttgtaaatcatttctgaaatttataaggtttccagctgacaattttctgccaagttaacatttcaaaaatgaaaaacaaaatcaatgtgtattttagagtatcatctagatctgcgcccctttgtaaatggattctatggtggttaagtcatctagaaacaccctgggagcaaggttccatcctactacttcctaattacatctgatctgctttatttttgtgtcctctttatactagctgtttctaactggggggcggttatggaatgtttcttagtgacagctggggcctgccaatctcattcattgttttctacttctgcacgtgcatcaaagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaat

SEQ ID NO: 283364 - DNA, 976 bp, Homo sapiens
ccccttccagtccctgctccttcaatagacagaagcacgaaacctcctctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcaaagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggtaaggatttcaaatttcgacattttcccaaagtctttatttatgccactctgcatgccttcatggagcgatctttgagagtccgtgctgtatggcaaatttaggattaaatcacatgagtgaagcccttcatttattggaagagaaataaagcaaaatctttacaatggttact

SEQ ID NO: 283365 - DNA, 914 bp, Homo sapiens
ttcccccccccccccccctctaacgacgccatgatcgagctcgtacccggggttgttggttagattaccgaagaagactaaattcatgtgtaacagtgcagattatttaattgtatcacaaaatgtaaaattgcatgcatggtttgatggaaacatttctcacatttatgtcttctaacacacgtgggtaaagaatcagtaactgccaatgaatgagatagcataaaattttgactttcataaaacaaaacttgtaaatcatttctgaaatttataaggtttccagctgacaattttctgccaagttaacatttcaaaaatgaaaaacaaaatcaatgtgtattttagagtatcatctagatctgcgcccctttgtaaatggattctatggtggttaagtcatctagaaacaccctgggagcaaggttccatcctactacttcctaattacatctgatctgctttatttttgtgtcctctttatactagctgtttctaactggggggcggttatggaatgtttcttagtgacagctggggcctgccaatctcattcattgttttctacttctgcacgtgcatcaaagacctttgccccagccagcactacttcctatgagctccaacactttcccttcaagatctactaagccaagtcccatgaaccctctcccatcctctcacatgcctggagcattctcagaaagtaacaggagttttccacaaagggccttccttgcaccatacttctctcaggccctaacaaacgccacctattaaaggccctaagggccagaacacttttcccctttgccaacttttcaaaccaaaccttcgtgccccccaatttcccccctcactcggcaaaccgcaattttcattcaatgtacgggcggccccgctttttttttctc

SEQ ID NO: 283366 - DNA, 679 bp, Homo sapiens
cagactgcatttcagggccctctgggcccgcctccccaccccagccctgcaaatgctatcaccgtctgctgcagagcccacctaacatgcacttcccttctcacctggcttactctctccttgcagaccctaagccctggggattcactgctcaccaaagacaagcccattaatataatttcctagcaaaagggaagtcttctgagaagaggacttctgtattctcccaactcaaagagctcaagttgcagccaatttttaaagtaactgttaagtgccctttacacagttgaatgttgttgctgttctgctttataaagcttgttagactttggcatggtccacagcggaatgtagttccattccctgtgtgctgtgttctgtccctgtgcccagcccccatggttttgggggcagcagggaaagtgataccaaatcaagaagcatttgcagcctggcttccctaacccagctcccctgtctggccccatcaccccaatccaaataaattttgttctttttctgtctcctcagtaacagcagttttccacagagtgcctccctgccaccatacttctctcaaggtttgtactctgggcttttgtgacgtgcttcagccatcaagcctttatgactggatccctaacctgtcccaaaagctttcgacaaaggttttatt

SEQ ID NO: 283367 - DNA, 444 bp, Homo sapiens
ttttcttttcacttacatctgtaactgtaaaatttattcagtttctaaaaatttacattttcagaattcattaaatgaagagtggtacgtttcttatattacccgaccagaggcagaagctgctcttagaaagataaaccaggtattgtgctatagtttattttaacatagttgtaaatattaatggcagagaagggaactgacctgtcctgagtaccaattacaagctaggaattctgctaggtgctgttgctttctgtaatacctaggagacccattagtgccagcttcacaactaccagcacccatagcagggattcctaggctcgggaatcattaggctggcagaagaatctcaaggcagtcatttggttggcagcatcttaggagattttattaatgaaagagtctgtcttgtcataggaatcacatggtgtcagaagg

SEQ ID NO: 283368 - DNA, 714 bp, Homo sapiens
ccccttccagtccctgctccttcaatagacagaagcacgaaacctcctctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcaaagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatgccattctggcagaacgtctaaaaaaacaccatctattctctgtgtgcaagtaatccactcgacga

SEQ ID NO: 283369 - DNA, 935 bp, Homo sapiens
caactgacagactaaacttcccttgcacttcatctattaccgacagatatagtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaat

SEQ ID NO: 283370 - DNA, 595 bp, Homo sapiens
ccccttccagtccctgctccttcaatagacagaagcacgaaacctcctctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcaaagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagggttaggtgaggttcgcgggtaggagac

SEQ ID NO: 283371 - DNA, 310 bp, Homo sapiens
taaaatgatatatctgatgcatttattaatagaaaaagatctgtagctcgaagtgatcctctctaggcaggatatagtgagtaagggaccccatcacttcttccattgtacatatctgtgttgaattttttatagtgaacattttttacttttgtgatcagaagaaaaatttctaaatgttatatttgtataaccatagtcatgttatttctttgaataacctatcagtgatttatatttctgtgaggtttatatgtgtgtattcttaaaacattattttcctttgcctccttcaaatttatacaggtcc

SEQ ID NO: 283372 - DNA, 326 bp, Homo sapiens
tgaggttctgagaagcaaggcctggccaggcctcctggcctagggaggcttagggccaggctgcccccaaggccaggccacaggattgtctggggcacagggcctgctgctgggctaatacccctcttcctgcccgccagcatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagct

SEQ ID NO: 283373 - DNA, 2781 bp, Homo sapiens
tcagcagctgccctcactgggcagggcaaattataccgtggcccgaccataaaagccactttccaaaaaaagaagctttaaggcccccgagagacgcagctgagcctctcacctggcagtgcctgactcaggaggtgatgtctgggccatgagccacagagcctggtgtccctttaagcagggagtacaaattctcatccctccctcctgctctccctgacgtcagctggaaggcgtgtgagtgagtgaggggctgaggtaccgcccgcgcgagcacacacagacacacagacacacacacacacacacacacacacacaatcttccagacccatcccctgcctgccagctccacgagccagagagagacagagcgcggacgccgcaggaggcagtgcctggaccccagctgcccaggagagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcaccgcccagttgtgccccgcgctccactcccccaagtccccagtctggcccacgcttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgacatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggcggggggttggggagccacacagggtgaacgggcagcagccggctccatgccccactgccctggctgatgagtccttcggtggcctcagtgtgcacgtctgtctgtccgtctgtgcttgtggctatgagcgtgtgcctccacccaccccacgacccgtgactactgtgcaagctggccaggaggtaggtggagggcaaggccaccagacctggcttcgcgctgtccactgcctctctcctcccctccctgccgcagacacgcaggacccgctcgccctcctgcttacccgtccccacggtgactgagctgcgagagcctgcgctgggctcactccctggcctccgcccctgagctgtcccgtgtcagtccctggcccggagccaggctctctgtgctacttacatctccctcccttggctgaggtcccccgccacagcctggacccttccctcagaagcctggccgatgggtgcttttggggagcctctcagcctctggcaggggaggaggactgacacggaggcacacaggcctctcactgccgaggccagccttccttcctgctctgctctctcagtgccatggagaggcaggaagaggggcctgagggcggaaggggtttggggctcccatttcgccggccagtccctcctcctcagcctggcagtggcgctgggctccttcccctgggctgtactgagccgagcccaggggtttgcagagggtgggggtccatctctccagcttggctgcagacctcctttaccctgactcacaagccccactgatgctctgggccatgcccggctgacggctgctgtggatgccgcgagggacggacacacgtccggggcacccacgaggagggcccccagcctgggagactggccctgcggcctccacgtcaaactctcttcccaaagccctaacagaccagtggccgaggtgtggctcttattgcatccatccctgaagatgtgtggctgttgctgtcacctggagtccttttggggccaagatgtgtgtgcacccggggtcgtggccattcactcccaggcaggggtgagggtggcctggcccaggaggccaggaaggagggccctgtctgcctccacctctgggtgcaccccctgcctaccaccctcccttctagagagcacatcgcctgaccggggagaagtggggccgtggttcgagggagggctggccaggggtgggacccttatgagactcagtctgtgagtaaaactgggggctcaaatgcccaggatgaggggatcagtgactgtctaggaggatcccttgccttgtaggtgccccaagaccgcagggtagaaatcagccgggatgcctgcatcccacccccggccccagggcccaccacataaaatctgggagcccagagctgctgaggtgtggtcagctcccctaaaatgggcacggcccagcctgtcccatgaggaataaaggcccctggcccccttgagagagggcttgttggtgagggctgactcctgggggcccccaaggctcccctcctgtggggaggccaccttttaaggcaccactagcagtcaggatatggtggcatcagccctggggcctcctgggtggcaggggggcagcagctctcctccccactcacaggccctgcagtgctcatttggaattcctcccaagacccctggccacccagaccccccattcttcctaacactggcaataaaccctcaactgtgacccac

SEQ ID NO: 283374 - DNA, 629 bp, Homo sapiens
aggtacccacaaggcaggcatattagcaacgtggcaatcctgagcaacagtgctcacaccattgaggtctgtgaacagtcacttttggcattcaccctgagtgaaagatggaatggcttaagtgcaaatgcaccatattataaacaatttcttacaaaaaaagtcccggattctcgtgccgaattcggcacgaggagagaactagtctcgagtttttttttttttttttttttgtttttttttttttttttttttttcaactccggcgaggtcgggaagtccgttcatgcagagttaccaaggttgtcacgttgagatgctggacttgaaatctggagtcctgcttcctgtggctagataatcctgggtctgtgcgtcttataaatggaaatgaaaggacctgcctttcctgttgttgaggtcatcgggaagatcaaatatttgagaagtacttcagttcatggaagcagctatctccttcacttactagcagtaagactttgttttcatcttcgagtttcaaattcttcactgtaaaatcttggtgattaaacacaatgcagttgctgcaaagattatataaaaaaccaaaaaaaaaactcgagactagttctctctctctctctctc

SEQ ID NO: 283375 - DNA, 2341 bp, Homo sapiens
aaaaaaaaaaacaaaacttagttgtgttctctttatctgaaaatatactatttacctatttgttaattttattgtctttctctgccatttagaatggagtctagaatgcagggatttctctgtcctgttcctgctgtctcttcagcatctagaatagtactgggtatatagtatgctcctgataaatgttttgaacatatgaataaacattattcactttctttttataagacctaactgttacattctttttactttacttttaaatgtaaattattacatttttgtaataatttttattttaatagttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatgaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaacctgtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaatgccacttaagcttgattttttagatctttttttaaaaaatgaataaaactaggcttactgttggctg

SEQ ID NO: 283376 - DNA, 269 bp, Homo sapiens
taactattttatttctacactgtgatctgtgtttactatttatccgtattgaaactttgataacctttatatgaagcaattactatttagcctaatcattcattagttacctattcagtgtttttatcaattgtagaaaacttcttgaagatggagcctgtgtcccatttctaaatccatacacagtccaggcagatctcactgtgaagccctctacatccaaaggctatttgcaagctgtggataatgaaggaaatccactttgcctt

SEQ ID NO: 283377 - DNA, 2578 bp, Homo sapiens
gtcacctgggggcttttctggggctgtcaactggaacaccgcaggatttctccatgtggcctgggtttcctcataccaatggtggctaggttcccaagttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatgaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaacctcaaagctgcatgaatcacacaaggtaacaggtgccgagcaaggtctgcaggtttctggattgccagatagtgcagcacctgaaggaggtgcagcgcacacaaatgatcagcgcaggtgtcaaaggatgaagcagccacttacagaagtgcaaatcctcagccactcatcttaatccttaacaagacagcactccagataggcagccacgaccccaaaggcttctggaaccaaactgattaaagttttactcagtggatagttctatagaattaatgatgatgtatgccaaaaacctttcagtgattctaacttcaagcttggaaaaaaagacgaggcttcccagtgtttgtggtggtggatctgcctggttctcaatttgacaccctaagcgatcatactcaagaatagtacagatgtgtggaatacgccaatacctttaactacagacatcatgttctcaagataaaagcctttaaaacaaaaagccatcgtaggtatcaagtcaacatgaaattggaatgcaaaattaatactgctgaggatttccttcatatcccatgctgtttaactatctcttccacagtcctagaatcaatcttttttaattaagagacagggtctgtctttgttacccaggctggagtacagtggtgtcatcaaagctcagtgcagcctccaactcctgggctcaatactcttgcctcagcctcctcttcctgagtagctgcaactacagacacatgccccaatactcagctaatttttaaatttttgtggagatg

SEQ ID NO: 283378 - DNA, 1361 bp, Homo sapiens
taggcagaacaggatcaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtacttt

SEQ ID NO: 283379 - DNA, 1474 bp, Homo sapiens
aaaaattagctgggcatggtgtcacgcacctgtagtcccagctgcttgggaggctgaggcaggaggatccctcgagcccaggaattcaaggcagcagtgatttgtgatcccatcactgcactctagtctgggcaacagagcaagaccctgtctctaaaaagaaagtacaaaagcttggaagcagggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtacttt

SEQ ID NO: 283380 - DNA, 605 bp, Homo sapiens
cagtccgtggcaccgcaatcaggggtggcgccaccccgccccgggcctcagcgaagacctccgcccggccaacatggctggcgccgcctctgccacgtcaagaggaggggacggggcgtgagggcaggaagggggcaggaaggggcgggcgcagagttaccagggcaggccaccggacccctgagcttgcttaataaccggaggatttgagaaaggcgcgcggcgggcgaaggtcgcagaaagagtggagaactggtgccactcggacaccttagctcaccgagagaaatggagacggcctccaggacatcttaggaccctggttgattccgagaatcacaaatcacatctctgaaaaaagtgaaaagttcattctttcacttagtgcaacaaatgtttactgaaacttactatgtgccagacacaattgagatgctggtaatatgatgcaggcaaagtaggcccagatccctggcccgaaagaattcacgtactatttatgtattttagtcagcctgtcttttcctcctacattgcctctgccacttcaactctgtctccccccacccccaaaacacacacacagtacaatatttggctgattc

SEQ ID NO: 283381 - DNA, 494 bp, Homo sapiens
agcggccgcggaaggtgaggcctggtgtagacgccaaagtcttgtcaggagtgggcggggcagggtgatgtatgatctgaaaggccgggagtgactaacgactgtcagtgtgtgtgtgcctgtgaggctgtgtctgtgtgacagtatcattgtgtgcgattctgagtgtcacttggtgcagctgtcagctaatgtgactgcgtgtgtcagtgtgcatggagctggaggtgcatgtggctgtgcaagtgtgggattatgtgtgtatctgtcaatgcacatttttggtgggactgggttgtgtgtttgtgtgagagggactgtgaccacatgagggaatgtgttttgggaaggtctctgtggggtttgagaccatgtctgccagcgtgagagtgggtggctggctttgtgtgtgccaatgtgtgacttcagcagtagcagagcaaaagtgaggtttgtgactatgtgtgtgtcctgggtcctaacttaaaccgtgt

SEQ ID NO: 283382 - DNA, 732 bp, Homo sapiens
taaagccatctgagatacccaagtagtagaatcctttcaagcactggttactggtgatgaattttgttttgtactgtcacagagctggaaatttttggatccttttagttcatctgatttaggttataaattatgatggttgttccttcttacccccaacctgacaactattaacatgatgtacactcattttaaaatagttttgcagtctgttttctctattgagtggctacattgtgttattaaatgtgtatatttatatcgaatacagatgttcaataatatatctgtaatgtacatatgtgttgctaaatgtagatacagaagaaactatatggagtctgataattaaatgattattaaatgatacttgtaatgaaagtctgccccaaaaagtgaccagatttttattggggttgctgtgtatctccaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatgtatgtcattttggtggtggtggtgaaatgttttggtaaaaatagctcacttaaatattatcttagcctttgtatctaaataaattagctgataaaatacaa

SEQ ID NO: 283383 - DNA, 3019 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaatggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaa

SEQ ID NO: 283384 - DNA, 598 bp, Homo sapiens
ctcgcgaacgtgttatccaggtattcccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatacacgtcgcgaggtaccggctcgatca

SEQ ID NO: 283385 - DNA, 4306 bp, Homo sapiens
gcctggggatagttaaaggagcacagatgcacagttgctttctgcatgcaagtggccagctaggatccggggggcatcaagccatgatttttatttctgtgctggatgcattagcagctgtgacttggaaggttttatcctgaaggagtggaattgctgcagacgtcttggggttttggtgagcagtagatatttggggacattgtgctgttattgcagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283386 - DNA, 3137 bp, Homo sapiens
ggagtctgtaccttccagcacgcaacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283387 - DNA, 2756 bp, Homo sapiens
tgatcctcagacccctttttcctttatttgcattagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283388 - DNA, 4500 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagatacatcccagtcttcactcataatcggccccc

SEQ ID NO: 283389 - DNA, 4432 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaaagtgcatcattttatttataatctcactccttgaaattatagcaatctgtcgacg

SEQ ID NO: 283390 - DNA, 3609 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgaatggaaatttcagaatggagacccacacagggtgggggtgggctgaggagaggcatgccctcccaatggccttactacctcttccagccatggattctgaatcctgtaagacaaaagtacatcagagtcatccctgactgggtcagctcaccaaggctatatatacacagaatttcacattcagtaaaagtcaaaattcccaaatgcagtcttagaatcctggcaggcacacagacaaatggggcttggcaggtctgggattgttaacagcttggtcctcactcttcccctccagccacaaggcttagacagcaagggtgactccgtgttatgctgcagctgcccggagacagggcccaatgcaaacctcagcaagaactcagttctgacaccaagaagatccccatgttactatgaattctgaaattataatcttttagatgtctggatttttctttaatttctctaaagcaattcaaagatgcacagaaatcttcatgtcaagcttctgatcctacagctttgagtatttcttggtaagccattttgaggcactatgattttctataacttttaaataatttaaa

SEQ ID NO: 283391 - DNA, 1296 bp, Homo sapiens
ccgaatcctcctcctctcaatggatttggttagtaacttctcatgctagaggaaaaatgaagcttattatataagattaatgttgtgaaacacctgttatttggaattggtttggtacttcctcttgaaatttccctcattaagtttaggtcgtggctgttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283392 - DNA, 2374 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggtgaagaccccagctgctaacccattgctaaatccgcaccagttccctccctcctcccctcccctccggtgaatggaaagggggtgtgatcgggccttttggtggtggcttcttacagcattccctaaaaatcagtagctacatataaccaactttgaacagttcctctaaagagtgctaatttctccagttccatttagttgatttctttggtttcattttattcccccccctcttttttgtattgtctgttgttgttttgtttttactttgctttcagggattattttgtttggttttgttgtccacaatgctttttgtttggttttgttttctgtatttggggaatggatttttctgtattccaaaatcttaaattagctcattagaccaactttaaaaggaatctcatatactgtttatagaaaaatcaaaattaacataggaaatatatatataaacatataaaacaatgaaaaa

SEQ ID NO: 283393 - DNA, 418 bp, Homo sapiens
cgaagaagagaagaagtacagagtaagtgtcccctcacactgttcttttcgcctcatcctctccctggacatggcagcatttcagcaactcaaagaaacgacgaaaggttaagggaggcttctagggaatcttacaacaaaaaggcagtaaaccctggatagtacaccctgataaaccccagtcattatgtatcagcattttccttgcacaagtgtattcttacaaaaaaaaaaatgaaagcttaagtctacattttataaattaatcagtaagcaggaactggagaaattgttgaatgaaatcctttgtttgactaaaatttaattcaatattatcttctgaaatcttgttagcactgagctcgttctgctgtcagctctgtaccacaagagtggcaaaaaggcatttttgtgacgg

SEQ ID NO: 283394 - DNA, 4913 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283395 - DNA, 4829 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattgaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283396 - DNA, 3452 bp, Homo sapiens
taaagccatctgagatacccaagtagtagaatcctttcaagcactggttactggtgatgaattttgttttgtactgtcacagagctggaaatttttggatccttttagttcatctgatttaggttataaattatgatggttgttccttcttacccccaacctgacaactattaacatgatgtacactcattttaaaatagttttgcagtctgttttctctattgagtggctacattgtgttattaaatgtgtatatttatatcgaatacagatgttcaataatatatctgtaatgtacatatgtgttgctaaatgtagatacagaagaaactatatggagtctgataattaaatgattattaaatgatacttgtaatgaaagtctgccccaaaaagtgaccagatttttattggggttgctgtgtatctccaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283397 - DNA, 4377 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaa

SEQ ID NO: 283398 - DNA, 4859 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttattaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttcttatattcttcatggaatggagcccagatgaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttcaaaatactttta

SEQ ID NO: 283399 - DNA, 3157 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatccgttttcagttttaaagggtcgtgagaaactggctggtccaatgggatttacagcaacattttccattgctgaagtgaggtagcagctctcttctgtcagctgaatgggaaattcagaatgggagaccccacacaggg

SEQ ID NO: 283400 - DNA, 2193 bp, Homo sapiens
aaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatgtatgtcattttggtggtggtggtgaaatgttttggtaaaaatagctcacttaaatattatcttagcctttgtatctaaataaattagctgataaaatacaa

SEQ ID NO: 283401 - DNA, 1948 bp, Homo sapiens
tctctgacagaaacagagctctacaaactttctggcgacctcccaggaaaacagaaggaagctgtatcctgtacttcccctgggatctaatgaaatatacagcctctgggcttctttcaatttggactttcagatcgctaagccagtgaaaaggggatcctagctgtcacaaacgtcacatggtcagggtcacctgctgctcgggggttctcatgccagttgttgacataataagccccccttacactttaattacaattcacagtgtgcaaactatgcaatctgctttaaggcagactgtcttttaaatcaacactaaaattctactactaatatggcaatgcaatgtagcagaggaagggtgtgtccacatgactaactatatgcagatatctgccgtttgggagacagtgggtagcatttgccaaaatataaaatggtgttgctgaccccaattctgggagatggtacttgaatcttactgtgctctgagacttctttccataggccacaaaaaggtaatgcaatatacttcatgtgtagcattttacatttgtataactactattttttttcacatggctccataactgttctatgtactaatcttgcctatccaacagaaggagtgttgaagaacagtgaatttctacttccctatttcttcccctttaaacctagggcagtgccagtgatgtttaacacatgcttctagagttgtgtcaatgctctatcatttactggatccttgtattttgctaactacagacctgtgtaagctatatttttgcaatcaaaacatgaaaggtcattttaaaacagagcccatttaaaatgatatgacaatgcagggagctgtttaaaaagtgctaacacataattatagtctacagttttctccaaaaacaacagtggaaattagttacaattctattacagacaactgctataaacttaggtgggctaacctctgaatgaactatcccagtactctgggaattgcaatctcattttcagtgccacaaatgacgtaagatggaacacacaaaacaaacccacacaaagtactttatgtttatgaagtcttactcaaacaccttagctgagctaaccagtatgtctcactgtaaaacaccaccaccaccagtaacaacaaaataaataatcaaacaaaatagaagaaatccaaatagaaaaaaaaagttttaaaaataataatgcctatacttgctttaatgaaggatgtacctgaattacaaatgccatcatgacagattaaattagccaataattagtcactgctttattttttttagtgtcaaacaatggtagataccaagacaagtaacaacaaaaggcaaaagagtttattttatttagacgtggtcattctaacataaggagaagatgcattttcctttcaaaaattgaggtctctttgggcaaactttcagtcctttggctattagggtttgtcttcatgaaggcagacataaagcaattctgttctcttccttatttgaacactttcagtcttcacctggctctctgccaccccagctaaaccacttgacctctgattacataacagtccccatctgtgagctcagccatcctcaggagataggaggggccatgagaagctcaagttcaccatgagccacagcagtaagccatgctttagcctctgacctgtgctccaattttggtacaatgatttctgccatgttctccaacaggtaagctctacctcaaggactaacttctgtacctgtatttggtcaagtgccctagctcatctggaactggagatgttgacttgcttttccctacctgcctcccaagaacaaaattctggcacggaaacccaggctagcacgtggagccctatgacccactgacagacttctctgacactaaccttctgcctggattactgtcatctgct

SEQ ID NO: 283402 - DNA, 2025 bp, Homo sapiens
tctctgacagaaacagagctctacaaactttctggcgacctcccaggaaaacagaaggaagctgtatcctgtacttcccctgggatctaatgaaatatacagcctctgggcttctttcaatttggactttcagatcgctaagccagtgaaaaggggatcctagctgtcacaaacgtcacatggtcagggtcacctgctgctcgggggttctcatgccagttgttgacataataagccccccttacactttaattacaattcacagtgtgcaaactatgcaatctgctttaaggcagactgtcttttaaatcaacactaaaattctactactaatatggcaatgcaatgtagcagaggaagggtgtgtccacatgactaactatatgcagatatctgccgtttgggagacagtgggtagcatttgccaaaatataaaatggtgttgctgaccccaattctgggagatggtacttgaatcttactgtgctctgagacttctttccataggccacaaaaaggtaatgcaatatacttcatgtgtagcattttacatttgtataactactattttttttcacatggctccataactgttctatgtactaatcttgcctatccaacagaaggagtgttgaagaacagtgaatttctacttccctatttcttcccctttaaacctagggcagtgccagtgatgtttaacacatgcttctagagttgtgtcaatgctctatcatttactggatccttgtattttgctaactacagacctgtgtaagctatatttttgcaatcaaaacatgaaaggtcattttaaaacagagcccatttaaaatgatatgacaatgcagggagctgtttaaaaagtgctaacacataattatagtctacagttttctccaaaaacaacagtggaaattagttacaattctattacagacaactgctataaacttaggtgggctaacctctgaatgaactatcccagtactctgggaattgcaatctcattttcagtgccacaaatgacgtaagatggaacacacaaaacaaacccacacaaagtactttatgtttatgaagtcttactcaaacaccttagctgagctaaccagtatgtctcactgtaaaacaccaccaccaccagtaacaacaaaataaataatcaaacaaaatagaagaaatccaaatagaaaaaaaaagttttaaaaataataatgcctatacttgctttaatgaaggatgtacctgaattacaaatgccatcatgacagattaaattagccaataattagtcactgctttattttttttagtgtcaaacaatggtagataccaagacaagtaacaacaaaaggcaaaagagtttattttatttagacgtggtcattctaacataaggagaagatgcattttcctttcaaaaattgaggtctctttgggcaaactttcagtcctttggctattagggtttgtcttcatgaaggcagacataaagcaattctgttctcttccttatttgaacactttcagtcttcacctggctctctgccaccccagctaaaccacttgacctctgattacataacagtccccatctgtgagctcagccatcctcaggagataggaggggccatgagaagctcaagttcaccatgagccacagcagtaagccatgctttagcctctgacctgtgctccaattttggtacaatgatttctgccatgttctccaacagggtgaggaaacagacagcactaagagaaaaagctggaactcaaaaccaaattaactccaaacttaagttttcccacttcgacaagaaaaggaactgcatgtgtttttctgcctcttgcagatgtatgtcataaaagttggatgccttcctttcaagacatttgaatggatcaccaaataattacctacttttctctcacaactcagataaataattaaaaggagatatacacagattggttgcatacttaagagtgagaatcaattaaaacaaaattgtatgcatg

SEQ ID NO: 283403 - DNA, 650 bp, Homo sapiens
tagcatcctattaatttaatagctttggttttgaatttacaatgctgataactgcatttattgaacattcactaaatccaagatacaacactaaacagttctcatgtttcacaagttttgttttcattcagtttttacaagaatcctataaatcctcattaatctcattttacagatgagacaaaaagcaagctctgaaagtttcagcaaattgcgcaagctcctgtcacatctagaaggtgggattttacctaggacagagtgactctacatcttcaccacattatattgaaaagggaaaagccagaagcatttggccctatcatttttatctctaaaaaactgctggttcctgctctgaaacagttcctccacgtgaaataaataagcagctaggttttctttttatcagcttcagctcatttggtccaggtgtgagggtattaagggataagtctaaatacaatttttgttttcttcctgaacagaaaatggacaaaaataaagatggggttgttaccatagatgagttcattgaaagctgccaaaaagtaagtaatgaaagtgtaataactatcaattcagctatcataacagctaaactgagtattagcagctagctaccatgaactgggcgaaatatagagatc

SEQ ID NO: 283404 - DNA, 521 bp, Homo sapiens
tgggatagaagtagtttatggtgaagctccaaagtaaatatataacacataaagattacacccttgtttcctgctggcatcttaataaatactgtgaatggaataaagatcatggttggaatcagatagaaagaaaatgtatccaacccatgtttcaacatttagcctgaagcctttcttttccccacagcatgtgatccataaggaaatgaaattttacaatcatggggattgtggaatgacctgacgcaatggtggggtctccaaatgcacgttgaggcagactatccaggaaacaaggttcacagaccaaattaagatactcgtattacacagtttattaaaccaatttaaaacacagcgagaagtaaagaaagggatggagtaagttaaccacgcaggacaggctgcaaatggggttgaaagaccactccctaaatcctgggcattctcagtgtgcctatgtcctgtctctctttgcctcacgagacttccccagaattgagttttgagcaagaggc

SEQ ID NO: 283405 - DNA, 400 bp, Homo sapiens
aatgaagaataaagagtgggctagcgacttccaggggatagaacagaagcggttattgagcattcgctgtgtaccaagtgctgtccttgacaagaagacttacacccagtggtcccagagggagacttcggaagtgggagcacctgtcagatcatcatcaaggaaccagatttacctcccacctgaaacaaatgatgaacaagcaaaaccataaaataactgtttttagacattgagcttcaggcattgaagaacagtgattcttgatattgggaagcaagccaacaatttgtgcttcagggagagttttccaaaccaattgttattaatgagtcacacatcatatctgatttatgatttattaaactttatgcattaaatactttccaaacaagacaag

SEQ ID NO: 283406 - DNA, 2342 bp, Homo sapiens
agcgggctcccagcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283407 - DNA, 2258 bp, Homo sapiens
agcgggctcccagcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcgacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283408 - DNA, 2340 bp, Homo sapiens
aaagatggaggctctgtgtgagaaggaatgcagggcagcctctggttgcagagagcagcacccggtttgacagctagcaatgcaattgtgacctcagacctacaatgtcaaggaattggcttctgccaacaaccagaatgagcatgaaagtggattagtccttggaacttccagataagagcccagccagctatacttggatttcagcctgtgagattctcagcagagaacccagtcaagtgtgtccagacgtccaacctacagaactacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283409 - DNA, 2081 bp, Homo sapiens
tagcatcctattaatttaatagctttggttttgaatttacaatgctgataactgcatttattgaacattcactaaatccaagatacaacactaaacagttctcatgtttcacaagttttgttttcattcagtttttacaagaatcctataaatcctcattaatctcattttacagatgagacaaaaagcaagctctgaaagtttcagcaaattgcgcaagctcctgtcacatctagaaggtgggattttacctaggacagagtgactctacatcttcaccacattatattgaaaagggaaaagccagaagcatttggccctatcatttttatctctaaaaaactgctggttcctgctctgaaacagttcctccacgtgaaataaataagcagctaggttttctttttatcagcttcagctcatttggtccaggtgtgagggtattaagggataagtctaaatacaatttttgttttcttcctgaacagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283410 - DNA, 1721 bp, Homo sapiens
gtccttcatagtcatctatgtggaaaatggatagaatagaatggcatttacatttgcaaacacttaatatttgagcttttggcataggtggttgaggtggttgatgggaggaggcaatactcaggggcaaaatagtgtacttttccttgcagatatgctgaatttaatcgctctgtgtttctcccttacaggatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283411 - DNA, 476 bp, Homo sapiens
gtttttttaaaaatgtcatataaaattgaatttttatttcttttcaggatttcatcaaaggtctttccattttgctccgggggacagtacaagaaaaactcaattgggcatttaatctgtatgacataaataaagatggctacatcactaaagaggtaagggatgcctcaccaacatcacagtaatttggaccattttcatttcttaactttaaaatattaattgcaattattaatttgaaaagtttttttgaggaaattccaaaatattttatgtagtggaagaaagatgtacaattaaaaacttgggatagaagtagtttatggtgaagctccaaagtaaatatataacacataaagattacacccttgtttcctgctggcatcttaataaatactgtgaatggaataaagatcatggttggaatcagatagaaagaaaatgtatccaacccatgtttcaacatttagcctgaa

SEQ ID NO: 283412 - DNA, 826 bp, Homo sapiens
tgcaactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgttgcttaagatgagtggctgtagaaagcggtgtaaacgtgaaatactgaaatttgcccagtaccttctcagactattaacaggttctcttcatacagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggtaagggatgcctcaccaacatca

SEQ ID NO: 283413 - DNA, 2360 bp, Homo sapiens
agcgggctcccagcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283414 - DNA, 2370 bp, Homo sapiens
agcgggctcccagcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcgaagcggttattgagcattcgctgtgtaccaagtgctgtccttgacaagaagacttacacccagtggtcccagagggagacttcggaagtgggagcacctgtcagatcatcatacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcgacaactaatccagattacagtatgatttagctcatcataattcagattatttttaatcaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctact

SEQ ID NO: 283415 - DNA, 645 bp, Homo sapiens
agcgggctcccagcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgtaagaactttctttttgactttaccttcacacaattcccagaggagcattgagaaatgagaggaaaagggggaaaatatcccattctatgagagccccatcatatgtatatttcatactgatccttcccagataggaatataatcagtatctgtggactttgaatctctgtggcacacccatgctggcatactgtaattgcccattaaacaaagagtttttgagaaaaaaa

SEQ ID NO: 283416 - DNA, 410 bp, Homo sapiens
aaaagtatatcaacagattaatgcattccagctgaacgttttagcctttttagtttcagctatccacaaatcaagccaccgagtccagctggtaggtttgtaaccattttgccaaaaatgtcttgagtttggggacaggaattggaaaatcttaacccaaagtattttaaaatgtattgtatttgagaaatgggaaaagaaacaaccacaggtatattacagctattgtgtcatctgccctcttgtgtctaatacctgtcctttgaacagcctctcccactaggtctggatggaggataccttaaagtgaaatgacagaccaggagaataacaacaacatctcaagtaacccctttgctgctctttttggctccctggctgatgccaaacagtttgcggcaatccaaaaa

SEQ ID NO: 283417 - DNA, 391 bp, Homo sapiens
gtatacgactagagcgacatactaaaacacacgcaagatctgtcttgaaaaatgctgttgccggggaccctcagatcatgttacctgagcatcctcagatgaaccaagcatgcaatcagagggagaatgtcgcgtatccagtgttcacctctgatacccacatccacccccaagcgatgcgcaccttctcactgaccttctctgcttggatcagaggcagttttcttatttccttgcctcgaggtgctgtgtcatacagcagcaggaacagacagtcagacacaaggactcgaggcaatggcggcggctgtgtatggggattgactcggcacctgggactcaagacgagataaccgctttatcagattaaagactgcgattggcaaactgt

SEQ ID NO: 283418 - DNA, 397 bp, Homo sapiens
cttacaacctttgttatcactttattccagtattaaaagctagtggcagtttcagaaatccccctgaaaacttagaggattctgacgtttcactttttttttaggtaagtaacatcaaatatgtgtgacctggctgacccagcctgccttaccaggcctctggaggggaccctggggttaccctcaggagatgaatctcacagtatggttttcctaaccagctctcttttggcttcactgtttttctttatctggcctgaaccccaggtctttgtaatcatttgctgttatcttcccctttcttgctccttgtttccatacccctgccatgcaagatgtcagcctagattaactcagccattcccctctgctgtaatatccaaactgcagaccattg

SEQ ID NO: 283419 - DNA, 473 bp, Homo sapiens
tctccctctgttgcccaggctggagtgcagtggtgcaatctcggctcactgcaacctctgcctcccagattcaagcgattctcccacctcagccccttgaatagctgggattacagaaagacagctcttgattcctctcttaatttctgtagtaagacttcatcttcagcaggcagctgaaaatacaaggtctttagacaaactcagccaagtgtcaaccagaaaacatttgaatttacctgtagcctggaagccccacttcaaattgtcccacctttctggatcaaaccaatgtatttctcaaatgtatttgattgatgtctcatgcctccctaaaatgtatgaaaccaagctgcacccaaaccacctttggtacatgttctcaggatctcttgaaggctgtgtcacaggccatggccactcatatttggctcagaataaatctcttcaaatattttacagagttcaactct

SEQ ID NO: 283420 - DNA, 1116 bp, Homo sapiens
gggtggttcttacctgtaattcttcctgtccagcaaaaaccatttattcttcttgtccagttttaggaaagcatgcctgttgagattggatcacctttcttcttggagacagtcaaggcagtgcctattatgttggcctcccaggcaagagggtttgccaactggggtgatttccatgagcagagctttagaatgattcattccaacctgacttagaacaatttgctttatttcttcttttttaaattaataatagaggcagggtcttgctatgttgcccaggttggtcttgaagtcctggactcaagcagtcctcccaccttggcctcccaaagtgctaggattacaggcatgagccaccacacccagccagaataatttactttaaagagttcttcttccttttctacatcttagccccattaaattacctcggtaaaccttacgtcaaaacttggggttatggttttcatctttcatttccaggaactaagatgccatccctcccatcagaaggaacagagttaaaggagtataaaccaaaaataaaattctaaggccccccaaccatctgaatggacttcctcctcagtcagcgcccttaaaatttaacctgagagactgtttcagggcatgatgggaagtgggggtcaaacatgcctcgttatacctctctggcattaacatcaacacagactttaagtctaataagaaacattttgcaacctattctctctgaagcctgctagctaaaagcttcatctgcatgataaaaccttggtcgctacagcctcttatcttaacccagacattcctttctgtttgatcccaggtctttagacaaactcagccaagtgtcaaccagaaaacatttgaatttacctgtagcctggaagccccacttcaaattgtcccacctttctggatcaaaccaatgtatttctcaaatgtatttgattgatgtctcatgcctccctaaaatgtatgaaaccaagctgcacccaaaccacctttggtacatgttctcaggatctcttgaaggctgtgtcacaggccatggccactcatatttggctcagaataaatctcttcaaatattttacagagttcaactct

SEQ ID NO: 283421 - DNA, 616 bp, Homo sapiens
aaaaatgattcacattccaactactgacttttattaaaaagagtactattagatgaaaatagttttcacactattatataaaaagacccattttacttaccctaaggctaagatcaattaacagaacccctgggataacagcccaggcaccaaatctggcacctcagagtcgtccttgacttccctaaaccgctttcccccatctcagattctgagaatttggtttctgtcaagatgtgcctctccagccaggcctctcctgccaggacggtggccacagggccatctccctctcctggcgcccccaactgcctggccaaggtgactgctacacacgtggggtcgcagaatccctcgagtcacaacgtcttcaacgtcttgtcagtcccgtgatcgcactaaacgtatttaaagccccctactcctttaagagggtcacctctgtgtacaggcggcctcctcgtactaagtgtggtggcgttcaaggctccgagacacaggcgcctcccgcgccactccccgggcacaggaactcctactcatccctcagtcatcagctcgaaggtttcttctccaagaagcctgcccggcactcgagaagtagagccgcgagcct

SEQ ID NO: 283422 - DNA, 803 bp, Homo sapiens
cgcctcattcacggcacccctgatagcgaggtcggcgtcacggtgtaggcgcgcagttggggaaaccgaggcccaacgtgggcggcagctaccagagatggcacacggaggactcaaattcgtccattcagtcattcgttcattcattccttcgggaaaccttgcagatctcccaatctgggcaactctgagctgggcgccagtagtctgggggtgctgacgggaggaggggccagagttttcaaagacgattaaccgaggctcacgtcgcggagccaacctagaagttctctggggacagaaccttggcggacaactgaattaattgttctagtctccaggcccagtacatggatgcttgttggatgaattaatgaaccttgacccacaccaagattctgagaatttggtttctgtcaagatgtgcctctccagccaggcctctcctgccaggacggtggccacagggccatctccctctcctggcgcccccaactgcctggccaaggtgactgctacacacgtggggtcgcagaatccctcgagtcacaacgtcttcaacgtcttgtcagtcccgtgatcgcactaaacgtatttaaagccccctactcctttaagagggtcacctctgtgtacaggcggcctcctcgtactaagtgtggtggcgttcaaggctccgagacacaggcgcctcccgcgccactccccgggcacaggaactcctactcatccctcagtcatcagctcgaaggtttcttctccaagaagcctgcccggcactcgagaagtagagccgcgagcct

SEQ ID NO: 283423 - DNA, 3482 bp, Homo sapiens
cctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaacacaggagaaggtggcccctgtgagatactggtgggctatataggcgttttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaatgttaagt

SEQ ID NO: 283424 - DNA, 1439 bp, Homo sapiens
tttttttatggtattcagaacatcactttataaactgttgccaaattaccacttaaacactaatatccaaatacagaatttagaaaattattttaaattttaactctaccatccccccgagctctcggctatgaatttagtctgggaagagggctccgtaataggccactgaggtcctctgtcccaccacatcatcctcccccgaaaactagctgcccgactgctcaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcgttttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaatgttaagt

SEQ ID NO: 283425 - DNA, 3537 bp, Homo sapiens
cctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcgttttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattcaaaatttattgagctgcaactgtgtgctcagcaatgagaatatagcagtgaggtcgacg

SEQ ID NO: 283426 - DNA, 442 bp, Homo sapiens
gggaggcactttgatcccagcgtgtgtatatgtatactccatccagaattctgggggtggggtgcttctgtgttctccaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgt

SEQ ID NO: 283427 - DNA, 3536 bp, Homo sapiens
cctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcgttttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaatgttaagt

SEQ ID NO: 283428 - DNA, 3482 bp, Homo sapiens
cctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcgttttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgattttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaatgttaagt

SEQ ID NO: 283429 - DNA, 388 bp, Homo sapiens
gatgtacatggctgctgcaaatgtggtaccaagataaaagcagaggccaacagccccaccaaactctgggcccagtgcccgggaaatcataaagtatgagcccccagctaaaagacaaaacagaagaggtcatgtgcatctgctcttgagaacttgcaacgttcaggtgatctctaggagccagtgcagtacttacacagcagcagcagataaggacaattgcaaaagcctgaagaactccagctgtgcccaccacccatgtaaggcgtaaaaaaaggatcactccaaaaatattttgtagacatgggaggtagacacccatgaaggtacccatttggggggtctagaaagaaagacattgataaaaaatcacacagttatcctaaaa

SEQ ID NO: 283430 - DNA, 1021 bp, Homo sapiens
acactgctgccatagcggtctttgccaagacttgtccatgctgaggcccaattcctcccctggcatagggttccctgactggggctgcttgtgtaaagaatggatcaggcgacaaaggatctcctgtgagtcagaatttggtcaagaatttcagtgcatcttgatgctgattgagaataccacctgaaactgatctgaagtaataacaggctagcaacgtaatcatctctgtgttggtccatgcttgaatgaatgtacacggaatcttgggtgctgcctctccattttcagcagcagaagacatctacaagagaaacacactgccctttgaacttcaatgttactctgaaatacaatatattaataatattgctaaccaaaggatctattttaaggtcctagaatcaatctcccgcagataccaagggctgactgcactgagtttccttttggggtgatgcagatgttttggaactgcatagaggtagtggttgcataacattgtaaatgtactaaactgtactaaaaatgaacactgaattgttcatttttaaatggctaattttatgttatatgaatttcacctgaaagacacagcgagacatcgtctctaaaaattttttttgaagttataatcatgtgtattttccatgtacacataaaaggaaggaggaaagacattctcagaagttctggtgattatctacagatgatgggattataaatgctttaggttttcatttttatattttgttagattctccaagtattctacagtgaacactgctacacttaaaaataaggaaaatactatttaaaaatttaacacacatagtaattaacaacagagaccacatctcggttttttttttaacccttctggcatgccaaaattcataaaatttcttgtttctgtttgcttgatgttttattcaaatttgatgtcagagttaaaggttatgagctagatatatgttttagaatatttgtaaaaatatttacaataaaaaggtaagggctc

SEQ ID NO: 283431 - DNA, 292 bp, Homo sapiens
ccagagtcttgctctgtcgcccaggctggagtgcagtggcgtgatctcggctcactgcaacctctgccttccaggctcaagtgattctcctgtgtcagcctcccaagcagctgggatcacaggtgctgcctctccattttcagcagcagaagacatctacaagagaaacacactgccctttgaacttcaatgttactctgaaatacaatatattaataatattgctaaccaaaggatctattttagttaagtatgtttttgttattgctattgctgttgttcctaaggaaga

SEQ ID NO: 283432 - DNA, 292 bp, Homo sapiens
ggggagcgagggcactgcactgagcttttcagtccctgttgctcacacacagcatccagttcacaagggacgggcaacgtggacaaagaacgaaagacaacggacaaaaaactgaagggacctgaaattggagtttccagcgtggactttgaatacatgacagagaaaagacaaggttcagaatgttggcggccaggcctaaggtggatcccttggggtcaggaattggagaccagcctggccaacatggtgaaaccccgtctctactaaaaatacaaaagtaagccaggtg

SEQ ID NO: 283433 - DNA, 291 bp, Homo sapiens
agctgcatgagagacagaaggagcctggccagggcttcgtccgcacctgagcatccagttcacaagggacgggcaacgtggacaaagaacgaaagacaacggacaaaaaactgaagggacctgaaattggagtttccagcgtggactttgaatacatgacagagaaaagacaaggttcagaatgttggcggccaggcctaaggtggatcccttggggtcaggaattggagaccagcctggccaacatggtgaaaccccgtctctactaaaaatacaaaagtaagccaggtg

SEQ ID NO: 283434 - DNA, 868 bp, Homo sapiens
ctccacttgtcggccgttcttcgtccagagatgaacatgccggaagcggccgttcccagcttttctccgcaggcctctccaaccgagcttctattgtaaagcaccctatgccgcgcaaagcgtcatgggagctgtagttccgccgcgcccccgccgcgtccccggctctgagtggaggagtggaaagggagcgtgcgcgaagtcacgcttctggctgcgacgcaaccgccgctgggcgttttccacaacatttgggaagatttacaaggtatactccatttaggcaaaaataactgtcagggaatagtcattgtcaagagcagtttgtattgcaacccacaaattatacctctatgtcggtccagaaatccttcaatttaccaagagattatgtttgaaaatcttagaaaaaataaacaatcctgaaaaactaagtaggcagagcccatatctgttctgttcaccatcatataccaagtgccttacagaatgcctggaacatagtagacactcaacaaatattcattgaatgaatgaatgaatgacactaggcttagatactagcttaaaataacagaagaagaatcctaatttcattaaaagtaggaccagctttacagaccagtgggagatccaggctacagggagaacacatggaattccagaatcatgaaccatctggaaggggctgaggacacatatgaagtacagtctaaagcttcaggatcaattttgggagccagatgttcttcatttaacggcaaaagaccagaggatcaaggtttctgactagtcctgcttccccctactcccatgtgaactttgaattcagtttatctagttccagaaataaacaagttggtagttt

SEQ ID NO: 283435 - DNA, 1266 bp, Homo sapiens
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagaggtcaaagaaattcattgatcctatttatcaggtatgggaagacatgagtgctgaagaagccttctcatgggaacatgttctcagtgacgctgctacattgttgcaatctgagaggtgaaaaatgagactgcaatgtagctctgattgacatttctgttttgagtgttattgagccatttgttcatgtgtttaaggcccatttataaacatttttggtaaattatctcttcatgtcttttgttcattttcctattgggtctttggtcatttcttccctcagtttttaataatgctttctgtattagaactatttcccctatatttgatgtatgttataaatatttctcct

SEQ ID NO: 283436 - DNA, 1106 bp, Homo sapiens
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagacctgcctttcgccttctgccatgattgggaggcctccccagccacatggaactagagtcttgctctgtcgcccaggctacagtgcagtggtgcaatcacagcccactgcagcctcgacctccggagctcaattgatcctcccgcctcagcctcctgagtagctgcatctacagatgtgagccaccata

SEQ ID NO: 283437 - DNA, 1038 bp, Homo sapiens
  misc_feature (940)..(940): n is a, c, g, or t
  misc_feature (949)..(950): n is a, c, g, or t
  misc_feature (1003)..(1003): n is a, c, g, or t
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagatcttcaacttgctgctgagctngggaagacnnttactggatcggaacacagagttgggaggactctgtcagacagatgttacaancaatcaggagcagtgacaggaaattgagtatcgtg

SEQ ID NO: 283438 - DNA, 903 bp, Homo sapiens
ttttttaagagttttgccttgcaaacatttatttttaatgaataatatctattactcattaaaatataagcccagtttcacattctgagtgatagccacgttttctttctccttagcaaacttgcagatagaagacccatagaacggtaccctaaaagtgttactttctgctttatattgttatttttactagcacttgttatattcagcaatttctctggtaggtacagttgtcacatgcagctcacatccgcagagtcacttcagcatgttaatgcctctgtctgtgttgtttttttgttccacagtaagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagacctgcctttcgccttctgccatgattgggaggcctccccagccacatggaactgtgagtccattcaacttctttttctttgtaaattacccagtctcgggtatggctttatcagcagcatgaaaacagacaaatatactgttgtttcttattaaatgttattggcttattttgaaaacaaaagcttaccaaatacatgtgattatgggaaggggccagaaagttacactgcaagtaaaaatatcagtaactatgtttactgggtggcgatggcaaaaacaatagtttttcctttttttttttttggagagtcttgctctgtcgcccaggctacagtgcagtggtgcaatcacagcccactgcagcctcgacctccggagctcaattgatcctcccgcctcagcctcctgagtagctgcatctacagatgtgagccaccata

SEQ ID NO: 283439 - DNA, 1031 bp, Homo sapiens
  misc_feature (933)..(933): n is a, c, g, or t
  misc_feature (942)..(943): n is a, c, g, or t
  misc_feature (996)..(996): n is a, c, g, or t
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttatgattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagacctgcctttcgccttctgccatgattgggaggcctccccagccacatggaactatcttcaacttgctgctgagctngggaagacnnttactggatcggaacacagagttgggaggactctgtcagacagatgttacaancaatcaggagcagtgacaggaaattgagtatcgtg

SEQ ID NO: 283440 - DNA, 107 bp, Homo sapiens
atgtgtgataatttgtgcttttaaagatatcttacacttttcacttatttgtacctttaaaaaatctttttttttttaaaccaaaggtttgcagtatcttcagagtc

SEQ ID NO: 283441 - DNA, 1359 bp, Homo sapiens
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagacctgcctttcgccttctgccatgattgggaggcctccccagccacatggaactgtgagtccattcaacttctttttctttgtaaattacccagtctcgggtatggctttatcagcagcatgaaaacagacaaatatactgttgtttcttattaaatgttattggcttattttgaaaacaaaagcttaccaaatacatgtgattatgggaaggggccagaaagttacactgcaagtaaaaatatcagtaactatgtttactgggtggcgatggcaaaaacaatagtttttcctttttttttttttggagagtcttgctctgtcgcccaggctacagtgcagtggtgcaatcacagcccactgcagcctcgacctccggagctcaattgatcctcccgcctcagcctcctgagtagctgcatctacagatgtgagccaccata

SEQ ID NO: 283442 - DNA, 1029 bp, Homo sapiens
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagaggtcaaagaaattcattgatcctatttatcaggtatgggaagacatgagtgctgaagagctacaggagttcaagaaacccatgaaaaaggtcagtttgtgattgattgagcac

SEQ ID NO: 283443 - DNA, 985 bp, Homo sapiens
cccgaaccggccgccgccgacaccccgctccggcccggggctgaggaggaagccgagaaggaggagaaggaggaggcggcggagggcgggggaagaggacggccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagaggtaggtacttttaaacattgatgctggaggaggtggatttttttttctttttgagacgccatcatgga

SEQ ID NO: 283444 - DNA, 731 bp, Homo sapiens
atgtcggtaccgatacgctcctagacgatcagagctttgggtcaccttggggagctggcagagccagcaagaagggctgaatgattctgggtgaactggggacagccatgtcgccctgggagacagagcaagggtagcctgggctggccagatgccttcagggatgaagaagcgtatggggagggggagctgaaggatcaactctcctgagggtgcatctcctcagggcccaggaagggcaaggtggctgaggaggggtgcttcaggcttcctgcgagcaaccctggcctctccctccctacctgcagcaggcatggagtatggagcccgacaaagtggagtgttttgttttttccttttccggctttgctccatttcccagccatgcactgccccatttcctagccatgcactgccccagctgggacctgtgtctctggcctctggtggcccttggagttgactgtcctgctgctccttgaggccattctcagagagaggaagtggcctcattttaatccgcttcccacagccttgtcctttccagacccatgggagagggaggggctgagggtgtggctgagcccacccaagtcacgcgtcactctgcaggtccctctcccccaaggccgtggccttgggagcccgtggatcccagtgagtgacgcctccaccccccgccctactcgggcagtttaacccttgttgttcacttgcagacatcgtgaaca

SEQ ID NO: 283445 - DNA, 427 bp, Homo sapiens
  misc_feature (30)..(30): n is a, c, g, or t
  misc_feature (246)..(246): n is a, c, g, or t
  misc_feature (274)..(274): n is a, c, g, or t
  misc_feature (283)..(283): n is a, c, g, or t
  misc_feature (293)..(294): n is a, c, g, or t
  misc_feature (303)..(303): n is a, c, g, or t
  misc_feature (311)..(311): n is a, c, g, or t
  misc_feature (409)..(409): n is a, c, g, or t
tggatgtgaactctgtcctgataggtcccnctgctgctgctgctgctgctgctgctgctgctgctgctgctgctgctgctgttgctgctgctgttgctgcttttgctgctgtctgaaacattcaaaagtgaagtatatttaaaaaacaaaacttaaaagaataaatacaccatgagaaaaactattcataaggaaaatacattgtttcacgaatcaaagtagtcactggtattaaaagaatgcaanagcagttagtctgatacagattactttnaaatatggnagtgctgatnntaggaaatntagacatnaaatttaaatttatcagacaaattaagaggtaggtattttcatcacaaaataactatcatggccaggagtggtggctcacacctgtaatcccagcacnttgggaggccgaggcggg

SEQ ID NO: 283446 - DNA, 257 bp, Homo sapiens
tcatcaatgatgtaggtgctcctggggacaccccagtacacacaggcacgcacaggtgcacacacacatgcacatgtacacacctgcacatgcatgcaagaaccggcgcctgcatgcacttatgggccgtcccagagcaccgcagaggaagatggtgtgcgggcgggagtgtggaagccccgctgccaccgtccaaactgggccctcagcctccacccgcgacgcgggtctttgcacagatggagtggcgatagcca

SEQ ID NO: 283447 - DNA, 502 bp, Homo sapiens
cggcacgaggagcgcgttgttttcgaagcttggagaagtctttcagtgggcagtgcctgccctctgcacacagtagtaacttgatttctgctgtgaagcctgagtcgtgttatttggaaggcggtggggatccaccgggatcaggaacaaagagtgactctgtaatggtatcagaggcccctgtggtggtttccacacagaccagggctgctgtggaagctgtgcgtgccccgacaggaactctagtgtactgtgtgatcgcggccattagaaaggtggcctcttcagatggacccatttgggggataaagcctgtcaggtggtgccagccctgagcacactgcaggcacgctttggagctttggggctggtctacagggaaggcctccagccccttccatccaaaatgcgcccacagggttggggggtctgtaagcaaccactgtagctgcccccggttctcacagaattcctttccattgcagaaaataattaaaatttg

SEQ ID NO: 283448 - DNA, 784 bp, Homo sapiens
ctttcgcctcccggttctcaccctcatacagaccctcctttcagacccgccctcctgttcacagggacccatttcggagccctggctcacgctgggcgggaactgccgtgacgaattccccccaaggtgttgattatccatcccaacccagcctctggcttccctcccacctccaccccagctcccacaggcccctcgccccgttcatcggctgggcgctcgagacggcgcccccagatctcccaccgggcagtgtccccagctgcagctgaggagagaagcgccggcgtgcgcggtgccacgtcggaattggctctggggacgccgcagctgccgaagcgcagcgcgcggtccccacgcacgccctgcctccgggcggccggcgggctggcccggcgaggagaggagggatgcgcgccctcctcccgctcctatctgcgggtgccaccgcctgcgtcagggacccctggcccgatctttctgcccccgataacagaaaatctctttttcgtcttaaaaaaaaaaaaaaaaaaaaaaaagcctgtggaagactcagcagaacccaggaagcgcagaattgggagaaaagtctttggctggggctgtttcaagtctctggttcaatgggctgctcgaagccaggactgggatcttctgaggggtggacttctttggaactcgacaggaccttgaagactgggttcttagtccttatcacatatatgggctataatgaataagtctaaacagaaaagtcgaataaactggaaatgatgctttcaaa

SEQ ID NO: 283449 - DNA, 323 bp, Homo sapiens
gattttctccgaaatacgcactgctgcatcctgcagtcactgaagatcatttccaaatcagtttccccacccccgagaggaggccatttctaaagatgaaaaacaaaacccctcaaatgtagctgttatgtttttaaacagtggcacatatcacctttatcaccttgttgcagcttaagtcagtctctaatacacataaggtaatgcaatcacatgtggtgggggacattactgacaaagcaaatcagtcctaaaaacttctattcacctgatcttctggaattcgaaggacagcacctcaagcccgtctatcgccttcattg

SEQ ID NO: 283450 - DNA, 958 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283451 - DNA, 1042 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283452 - DNA, 1570 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283453 - DNA, 1526 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283454 - DNA, 2163 bp, Homo sapiens
cccacccccagtgggtccgccagataggcctgcgtgtcaccccagtcggtggcaccctgctgtcgcagccaggcagctgagctggaccagttggtgcccaggaagtctcggtaggaagtaaggcccaggcgcaggagcagctgtggcccccgagagccaataggcgccagggtggctgagtgcaggcggaacttgggggcgtcgaagagccagggttgggcctttagccgggtctcccagatggcagtgatggcctcgtccccacctggcagtgggcgacggtcatgggcggggctcagctcggcctgtatctgctcctggggcaggcccccgccagggcactgcagcagcaaggtcacctcaggatccatggtctgaaccagccgccgggtccctcaggctccgccccttccccgaagcggaagtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggtcagtgccctcccctccacctagctactcccacccactctgtcctcccaggtccccttcaaaggttacaacacttgtctggggccaccccatgtccggcatggagcagcacccctgcatcccccagcccaggaccccagtctgcctaggttgctgactgcactccaggtgcccaggcctcagctccagctgtctctgcaggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283455 - DNA, 1339 bp, Homo sapiens
aggctgtacgcctccggagtacgggatccagacccgagaacaggagaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283456 - DNA, 740 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggaccgagacgtgcagctgtccaaggctctgtcctatgccctgcgccatggggccttgaagctggggcttcccatgggagctggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283457 - DNA, 1771 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggtcagtgccctcccctccacctagctactcccacccactctgtcctcccaggtccccttcaaaggttacaacacttgtctggggccaccccatgtccggcatggagcagcacccctgcatcccccagcccaggaccccagtctgcctaggttgctgactgcactccaggtgcccaggcctcagctccagctgtctctgcaggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283458 - DNA, 1658 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgtgagaaccaccaccccagcccctattccttgttcctgaaagctgtgcccttctgccctcacctctctcctagcttccaaccctagactgacttaggtgtccctttctctaaccaactcttgtctttatcaggaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283459 - DNA, 1731 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcaggtgagtctggacaaagcaggagctgcccttgccttcggggagggcatgagtcacatctctggctctgtcagcaatggaatacccttcttccgctctgccaatggggtgattctgactccagggaatactgatggcttcctccttcccaagtacttcaaggaggccctgcagctacgccctacccgtgagaaccaccaccccagcccctattccttgttcctgaaagctgtgcccttctgccctcacctctctcctagcttccaaccctagactgacttaggtgtccctttctctaaccaactcttgtctttatcaggaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283460 - DNA, 1522 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283461 - DNA, 1258 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtgccaggcagggatcctcaagggtctaca

SEQ ID NO: 283462 - DNA, 1014 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtcggggtgaggggacaagtgcgagacgagatgggagggacc

SEQ ID NO: 283463 - DNA, 998 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283464 - DNA, 2391 bp, Homo sapiens
cccacccccagtgggtccgccagataggcctgcgtgtcaccccagtcggtggcaccctgctgtcgcagccaggcagctgagctggaccagttggtgcccaggaagtctcggtaggaagtaaggcccaggcgcaggagcagctgtggcccccgagagccaataggcgccagggtggctgagtgcaggcggaacttgggggcgtcgaagagccagggttgggcctttagccgggtctcccagatggcagtgatggcctcgtccccacctggcagtgggcgacggtcatgggcggggctcagctcggcctgtatctgctcctggggcaggcccccgccagggcactgcagcagcaaggtcacctcaggatccatggtctgaaccagccgccgggtccctcaggctccgccccttccccgaagcggaagtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggcaagtctggcctgctgggccttagtttccctctctgcagcagggacttgggggtggtgaacttaatgagccgtatactcccacccagcgctcacttcctgaggctttgtgactttctgggagggatggggacgtggaaggggccttaaagcagtcccccctcgtcactgccccccacaggtcttaaccatgaacttctctggaggagggaggcaggaagcagcagggtccaggggtagaagggctcccagaccccgagaacaggtgcgcgcctcctccccaccccctcccaccagtccaggctccctgggagttgctggggggcggagctgaagggtcctactattcctggagaccactggcactcctttctctctgggctctctctgcagtgggtcattgagggttcaggatgggcagtagggcagggtcaccatggagactaggggccaccgctgggttctttcaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283465 - DNA, 1230 bp, Homo sapiens
cccacccccagtgggtccgccagataggcctgcgtgtcaccccagtcggtggcaccctgctgtcgcagccaggcagctgagctggaccagttggtgcccaggaagtctcggtaggaagtaaggcccaggcgcaggagcagctgtggcccccgagagccaataggcgccagggtggctgagtgcaggcggaacttgggggcgtcgaagagccagggttgggcctttagccgggtctcccagatggcagtgatggcctcgtccccacctggcagtgggcgacggtcatgggcggggctcagctcggcctgtatctgctcctggggcaggcccccgccagggcactgcagcagcaaggtcacctcaggatccatggtctgaacgtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283466 - DNA, 1693 bp, Homo sapiens
cccacccccagtgggtccgccagataggcctgcgtgtcaccccagtcggtggcaccctgctgtcgcagccaggcagctgagctggaccagttggtgcccaggaagtctcggtaggaagtaaggcccaggcgcaggagcagctgtggcccccgagagccaataggcgccagggtggctgagtgcaggcggaacttgggggcgtcgaagagccagggttgggcctttagccgggtctcccagatggcagtgatggcctcgtccccacctggcagtgggcgacggtcatgggcggggctcagctcggcctgtatctgctcctggggcaggcccccgccagggcactgcagcagcaaggtcacctcaggatccatggtctgaaccagccgccgggtccctcaggctccgccccttccccgaagcggaagtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggcaagtctggcctgctgggccttagtttccctctctgcagcagggacttgggggtggtgaacttaatgagccgtatactcccacccagcgctcacttcctgaggctttgtgactttctgggagggatggggacgtggaaggggccttaaagcagtcccccctcgtcactgccccccacaggtcttaaccatgaacttctctggaggagggaggcaggaagcagcagggtccaggggtagaagggctcccagaccccgagaacaggtgcgcgcctcctccccaccccctcccaccagtccaggctccctgggagttgctggggggcggagctgaagggtcctactattcctggagaccactggcactcctttctctctgggctctctctgcagtgggtcattgagggttcaggatgggcagtagggcagggtcaccatggagactaggggccaccgctgggttctttcaggaccgagacgtgcagctgtccaaggctctgtcctatgccctgcgccatggggccttgaagctggggcttcccatgggagctggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283467 - DNA, 1702 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgtgagaaccaccaccccagcccctattccttgttcctgaaagctgtgcccttctgccctcacctctctcctagcttccaaccctagactgacttaggtgtccctttctctaaccaactcttgtctttatcaggaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283468 - DNA, 1599 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcaggtgagtctggacaaagcaggagctgcccttgccttcggggagggcatgagtcacatctctggctctgtcagcaatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283469 - DNA, 1565 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtccccttcaaaggttacaacacttgtctggggccaccccatgtccggcatggagcagcacccctgcatcccccagcccaggaccccagtctgcctaggttgctgactgcactccaggtgcccaggcctcagctccagctgtctctgcaggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagta

SEQ ID NO: 283470 - DNA, 715 bp, Homo sapiens
agcggattggcgggtccgccgcccgccccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggaccgagacgtgcagctgtccaaggctctgtcctatgccctgcgccatggggccttgaagctggggcttcccatgggagctggtccccttcaaaggttacaacacttgtctggggccaccccatgtccggcatggagcagcacccctgcatcccccagcccaggaccccagtctgcctaggttgctgactgcactccaggtgcccaggcctcagctccagctgtctctgcaggcatgcggtcccattgtgaaatagctgtgttcatcgatggacccctggctctggcagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagc

SEQ ID NO: 283471 - DNA, 341 bp, Homo sapiens
gaagctcagagctagattcacggctccagcttctgttagattccccgtgcccaccatggggctggaatcctgtaggtgctcaattattgtgtgttgactgagtgagcaggagggaggggctcaggcccagctcacccaccctcgccccagacctctcaccgtgacgctggagtcatccatggccttgacaaaggtgtggagagggactgttgtgccaggattgcactggtgaccccggatctgctggggaagacgcatggtcagctgggcctctgtgcacctgttggctgctacctagtcccatagaccatggcctctgactgaacctcccagcccaacag

SEQ ID NO: 283472 - DNA, 1030 bp, Homo sapiens
ggccgcacaagcgccggaccgggtaccgctgtgcccggcctggccgcggcctagtcccggcagacgggactgacgaggtcaccaagcccaggccgagacggcgcgggtgtcagggacttgggaatccccctcccccagtcccgatcccgctttcctttggggtttcacctcagaggacccgacagcactcttgcagaacagccgtctgcctgtcttcctggctcgctccctgcaggaatggtctggggcaaccccagcaacacgcccacctgtggccaggatgaataggaatccagttcaggcttggcttccatggcaatcaaggcccaccaggccccagcaaccttccctaccccccattcctttttgctgcccccctccacaccaggcatgttccctgccacaccatgctgttcccctcacctgggctgccctcccaactcctctctgcctctggagatgctctgccattcaagacttggctcaggctccaggtcctccctgggccttctagagcccctggttctcactcctctgaacacttccagcctggctaatagcccactgcatcctggcctggggtacaggtggccagcacaggtgtgggggccagcttccaacacaagcacgggtaggtccctctgcagaccatgggctgcaagaggcccggccttgcccactgcaggggccctgcgcagggctgggcacgaagcaggtgggtgtccaccaatctagtatccaaaaccctgcttggttcacccccacctctgttgaaggaaagcaacactgtgatggagaggagcagctgtggattcaaatcctggcttggccactttctagttgtgtgacttggtgcatctgccctcatctcctcagagacaaaaatggcaacacctcccttcttgggttactatgaggattaaataacaaaacctccaagaagcagagcccggtgtctggagagtgctcaatggacgtagttattattatcatcatcagcacagtgcggggcacatggtgggcattcagg

SEQ ID NO: 283473 - DNA, 1127 bp, Homo sapiens
ggccgcacaagcgccggaccgggtaccgctgtgcccggcctggccgcggcctagtcccggcagacgggactgacgaggtcaccaagcccaggccgagacggcgcgggtgtcagggacttgggaatccccctcccccagtcccgatcccgctttcctttggggtttcacctcagaggacccgacagcactcttgcagtttcctcatcctcaagatggactgcaccttctggcatctcaagtggttcttgtgaagattaaatgaatccatcaggccgggtgcggtggctcacgcctgtaatcccagcactttgggaggccgagacgagcgcatcacctgaggtcaggagttccagaccagcctggccaacaaggtgaaaccccatctctactaaaaatacaaaaagttagccaggtgtggtggctcatgcttgtagtcccagctacgtgggaggctgaggcaggcgaatcacttgaacccaggaggcggaggttgcagtgagccaagattgtgccattgcactccagcctgggggatagagtgagactccatctcaaaaaaaataaataaataaataaataaatggatcaatcagtttaaaaacttagaacagtgcgtggcaaatagtgctcaagaagagtaggcttgtgaaacattcacatgcattgttttaacaaacaatgcttccccagacctccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaaggaccctttcctcctgcgagaggagaacagtgctaaacctgtctgaacgtgatagacatgctacaaactgccaaccctttaggctataaactgctcacacatgggccaagtgtcactctcataagaaggtgtgattttttttaagctgccagcagccttgaagccacctgggactgcacagtatgtctgtgtgtgcc

SEQ ID NO: 283474 - DNA, 963 bp, Homo sapiens
ttgtcgagtaacttaacctctctccatctcagtttcctcatcctcaagatggactgcaccttctggcatctcaagtggttcttgtgaagattaaatgaatccatcaggccgggtgcggtggctcacgcctgtaatcccagcactttgggaggccgagacgagcgcatcacctgaggtcaggagttccagaccagcctggccaacaaggtgaaaccccatctctactaaaaatacaaaaagttagccaggtgtggtggctcatgcttgtagtcccagctacgtgggaggctgaggcaggcgaatcacttgaacccaggaggcggaggttgcagtgagccaagattgtgccattgcactccagcctgggggatagagtgagactccatctcaaaaaaaataaataaataaataaataaatggatcaatcagtttaaaaacttagaacagtgcgtggcaaatagtgctcaagaagagtaggcttgtgaaacattcacatgcattgttttaacaaacaatgcttccccagacctccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaaggaccctttcctcctgcgagaggagaacagtgctaaacctgtctgaacgtgatagacatgctacaaactgccaaccctttaggctataaactgctcacacatgggccaagtgtcactctcataagaaggtgtgattttttttaagctgccagcagccttgaagccacctgggactgcacagtatgtctgtgtgtgcc

SEQ ID NO: 283475 - DNA, 808 bp, Homo sapiens
ggccgcacaagcgccggaccgggtaccgctgtgcccggcctggccgcggcctagtcccggcagacgggactgacgaggtcaccaagcccaggccgagacggcgcgggtgtcagggacttgggaatccccctcccccagtcccgatcccgctttcctttggggtttcacctcagaggacccgacagcactcttgcagtttcctcatcctcaagatggactgcaccttctggcatctcaagtggttcttgtgaagattaaatgaatccatcaggccgggtgcggtggctcacgcctgtaatcccagcactttgggaggccgagacgagcgcatcacctgaggtcaggagttccagaccagcctggccaacaagacctccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaaggaccctttcctcctgcgagaggagaacagtgctaaacctgtctgaacgtgatagacatgctacaaactgccaaccctttaggctataaactgctcacacatgggccaagtgtcactctcataagaaggtgtgattttttttaagctgccagcagccttgaagccacctgggactgcacagtatgtctgtgtgtgcc

SEQ ID NO: 283476 - DNA, 4372 bp, Homo sapiens
  misc_feature (1149)..(1149): n is a, c, g, or t
taattgcttgaaggattttttccagacaggtggtctggaaaccttttacctattaccttccatccctgaaccatttcaatcttctgcctcctggatatcttggagaaaatgaaccaacacaacacagctttcagtttttagagcatttcccccatacagaacattgtcttacttgatcttcccgatgacctcaacaacaggaaaggcaggtcctttcatttccatttataagacgcacagacccaggattatctagccacaggaagcaggactccagatttcaagtccagcatctcaacgtgacaaccttggtaactctgcatgaacggactggatagtaaagtggaattattactgagaactgcaatgaataaaatcttttgcattttttgcctacgtttcacagagggtgatatttttctgaggcaattaaatttataccacggccacaatactgaaacgttctgaccaacaaagtcatgctcctgcatctacacagcagataactgcagaaacggcttcctttcttccttgtaaaattgcctgaaaacagctcccccttgctgtccgtcgaggcatatcttcaccaacgttaaaacagagctgagggagatcgcatttctgcctccctcccgccctgcagaggggctccagctgttcagagtaacggattactaggtaggtggttgtttcccctccttcccagggcctctttcctctctttgagattgcctctttcttactcctgagcacaggagccgggcgggttttctgtcccttgccctggacagcactgcctggatggccgctgtccggcagctgctctttgtccacccaaaaagatgtccccacgactcagtagtaaccagacggtccccacggaccactgcggccaaatttccgccatccccgctgtgggaatcaggcttttcccgcagaaaaccccaggaatctagagaaaactccttaagtccctagtctccatagagaaaaccaggagacactccccccaaaccccgctgtgaatacaggcacagcagccactggggctgaaagtgatgagtgcgttcttcccgtcgcaaacatagggtaataaatagcatgcatcaaagacgttactaggaagagatagctctttaagtcacgagnggggagaaatgtttgccccgggaaaatttgcctggggaataaaatttgccagactgctgcacgggtgagctcggtgagaaggaagaaacccggactggaggaggtgaggtcgagagccaggttcaggtgcaggagctagatgcgtggacgccggtgcgtggactggaggtttccaggtaccgcgcttagcgtgcctgttgaagtcaaatgcatggttaaggaggctagcgaggaaggctagtgagggaagcttgtggaaacggctacgagcccagaaaaggcatgactcgtcagttgtccaagtttttggaagggaaaagcgggaaagcgccacgatcccacctactgtgaggaggaatctgcgagtctcccagctccaccccctccacagtgatgcagaggacaaacaccgacgtagggagaggaaaaaataaaactccagggagcggggagtaggcaaccagcagtcttccggcaatagggcgggagggagcgcgtcccaaggaaacaagcaccgcataaatacttgagttgggaacccagtgcttccggaagctcggagctcaccttcccgacctcgccgaagttgaaaaaaggcagagcagggagaggggccagctcaccctgctgagagctgctcagtgggcaggcgggacgctgctccgggagacgcccactggagggatcgcagagcccggcaagctgcgagcgcgccaaagaccctgcgcttcggacgaggagcccaagtcctccgagacggggagggagcggcccgcgagggctggagctccgaagagggccgagtaggagctgcatggacagcatgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgtcggcctacatgctggtagtcatgacagccgaccgctacatcgcggtgtgccacccgctcaagactctgcaacagcccgcgcgccgctcgcgcctcatgatcgcggccgcctgggtgctgagcttcgtgctgagcacgccgcagtacttcgtcttctccatgatcgaggtgaacaatgtcaccaaggcccgcgactgctgggccaccttcatccagccctggggttctcgtgcctacgtgacctggatgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacggtgaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacgggtatgtggaaggactcgcctaaatcttccaagtccatcaaattcattcctgtttcaacttgagccttgcattcatgcaacttgattcttgtgattgactttttggctcattagctgaattgagctagaaatcacaagaacaaatacactttattaatataaccataaatcaattcattgtgtatgagactgtgtttctagttgcattttcatattgctaccaaaaactagacattattttgtatggaatattaatggaaacatgctgtactaaaatatgcaggtctgattcccagaaatacaacagaagttatatttttaaaggaaaaatcataaccaccctagctttatattttgttgttagtttcttttattttcatttctaacataagtaagacttgattggtttaaaagtcacataaaatgcggcactatttctgaacaaagagagctcatcatcagtcttaatattcagagaaaacttcagagaaattatgttttcatccattaaaattaatttgtgcatcagaaaatgcagccttaaacagtgtccaggagatgggatggtacctcctaggagtacaagtgcctggggtgtaatgagctcctgctcattgtggccagtttagagttctattagaagctatcaatcaccttgcatttcaaaatggtaactttacaactggcagtggcctccttttggttcctcacatattattggtcaagaaaagcatgaaaactgagatgctgaaggtgagaggaaatgttgactggccaaaaatatcttttttcccccactgcaaggttgttttaaagtcagatttgtataaggaaagccaaattttattaaaagagtagaaaaggattgcttaaggtactctggactttctcttggacattgtaaacgtattttgatcagtgttacaagggtatcctgtgctatgctggacattaacaagatcattatcttcatgtttggggaattcagattcataatatgagtatcctaaagagtgactcaggatataaagtgtcccaacatgtttaattaaaaatagctttgtctttccaatctctcactcatctaacaattgcaaagcagagatgagacagggttgggacatgggtgacagatggaaagagaactgctctgtgcccagactggcttccttcattattaaatccacaactttaggcaagtttctt

SEQ ID NO: 283477 - DNA, 572 bp, Homo sapiens
gctgcagtcgactctacagaattcccgtatccgtatcgtgattggtcatggctgctgattctctctgccagtgcgttgtttgagccaaaggtctcgtgattggaaacaccctgtgggtactggggttacctactccttaacaggaggccctcatcagaatgaccagggcccatctagcttcagtggctagggtcttctctctctgtgacagaagatacccttgtatctgtgtttgtctctgtctctgtctgcctcccctctgcctgcccccaccatctgtctgtctctgtctccctcactgcaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtgagtggacacctgcctaggggttga

SEQ ID NO: 283478 - DNA, 2121 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283479 - DNA, 3677 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283480 - DNA, 3163 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggtatgccagaaggtccaggtatgccagaaggtccaggtatgccagaaggtccaggtatgccagaaggtccaggtatgccagaaggtccaggtatg

SEQ ID NO: 283481 - DNA, 1458 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagacggcaagcgggggtaccggagctcgacatcgt

SEQ ID NO: 283482 - DNA, 3953 bp, Homo sapiens
cggacgcgtgggtcgacccacgcgtcgtcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggcaagtgtcattcctgtgattgctgtcctgtcccttggggttgtcctggctgtgtttctctgccactgccctgcttggccaaggttgggagtggggagggggcatgtttctggggttacctactccttaacaggaggccctcatcagaatgaccagggcccatctagcttcagtggctagggtcttctctctctgtgacagaagatacccttgtatctgtgtttgtctctgtctctgtctgcctcccctctgcctgcccccaccatctgtctgtctctgtctccctcactgcaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283483 - DNA, 3558 bp, Homo sapiens
tagcctagtagaggcgggtggtaatcggccgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatggaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283484 - DNA, 3059 bp, Homo sapiens
tgccgtcgctctgaggatcctccctggttgtcagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283485 - DNA, 1236 bp, Homo sapiens
ttgctggggcactctagaggatcttccgctgcgtcttcgaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283486 - DNA, 869 bp, Homo sapiens
aggaggaggaggagtcactaacaaactcagcatcagtgtccagaacaaccgaagtgttcggcatattaatggtgggtgtgtaggacggaaggttggatgtatgcagaactggcgactcagtagaaggctgagcatattccccgtcataggatgagacgttacttctctcagtctgagcatgagaaaaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283487 - DNA, 619 bp, Homo sapiens
aagaccatggatgatcccaaactgcatgggaatgaagaggtcgcaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283488 - DNA, 429 bp, Homo sapiens
cgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgagtgagtggaggcagccttcccctctgggaagcttagttcccactggggcggagctaagggccgggtgccatgcaccctgacacggcttcccccccttatgacccag

SEQ ID NO: 283489 - DNA, 416 bp, Homo sapiens
aatcctataccaaaggttaggtagtctcaggtcatttccctgtgacttgcttgtggaaattaaccccactgtctttatgtttaggctttgtccagggatctgaaaccactttgcagtcgacatactcggataccagcgctcagcccacctgtgattatggtaagtgtggacttctggtgggaaccaaagtgttctgcagagcagttccttgtcttcttagttgcctttggctttgctgtcaccctgtcatgcttttttaaacctaaacttgtgtgaaatggtgtggccatttgaatagctagtgcttccctttcaggcaattatgggaaaagtagctgtgttcctgagcaagttaggctctttgataaaaggcctggcttcaaatccccatgggggagggactgggagtcacagtg

SEQ ID NO: 283490 - DNA, 212 bp, Homo sapiens
ggctcccgcactggcgcttgcctcctccgcctcagactcttgctcttgctggaccttcctcagcctcgccggcgcccggcccctgggctctccagacaaagctgaccccgtggcccagataaggacgtccggcagaggtagggacccgccccgaggtctcggtggcggctggcctcctccgccccttgccacggcggcctgctccggcccag

SEQ ID NO: 283491 - DNA, 2793 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283492 - DNA, 2103 bp, Homo sapiens
cggacgcgtgggtcgacccacgcgtcgtcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283493 - DNA, 3142 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283494 - DNA, 3512 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283495 - DNA, 1486 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggtaagtggctctggctgggcattttctgtctgcaggcagggcgagctggcctaaagagtggtgctctccctgggggccagaggcaatgctgtgtcagctctgcgtgcatggtgaccagcatggggaggcagtgtggtctggcagaaagcacaggctgcctagctggaggcacagtttccttgttggaaaatgggatgagcccctgtgcaccaggtagtgggaggatgtgaggtttctggcacatagccgggccttgtcatttaaagccattgtaaataactgggctactctgggccaccctgcctataggatagccctgctctgtctatggagcaagcagctgttttactatataccgttgctctaataaacttggtttcttttaaaaaaaaaa

SEQ ID NO: 283496 - DNA, 3632 bp, Homo sapiens
  misc_feature (63)..(63): n is a, c, g, or t
  misc_feature (69)..(69): n is a, c, g, or t
ctgctcttgagtatcccataaatctggaatccgcagtcaccacgatgttgtgttgcccgccancatganctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283497 - DNA, 3575 bp, Homo sapiens
gggctagggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatggaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgcctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283498 - DNA, 2878 bp, Homo sapiens
gtttttatttagaaattatatccccaaacaagcttggaagcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggtgagttttcctggggtgcctggtgctagggcggctcttccaggggctcacagtgggagggacccagctgagggcagggttgcggcagacatgcggccagttggggacctcccttgtgggcccgagtgtgtgctggcagggggctttcttttcgccgcctccacccccttcccactcttcctcctccttcccaggcggaggctgtggatggtggtgacccctgcctagcacactggttttgccttcagatgggggcagctagtaaaagtgtggggaaccccaggcacgccccctgccctcggtccctcagtaacgcgcagttccaagtcctcagtggctggtgtccgatctgggaccctcggtgcagtttttacggctctggtgtgcgtatcctctcccttagcacctctccagcccctgttgggattccgtgtccccccacctgagtgatgagcgccagcaggtacctaacagcaaatccagcgtcagcccactgttgccgcggtgcccggttgggggtgggcagggccatgtgagcagcctccctgcatcccaccacctggcccctctgaacatgtgccagtgtccccacaaagataccccctctttgctttccagcctcctcctggcccactgcacagagagcatgggtgtcctggagagtggaggggtcatcgcctggcccccactccttggggcctaggccaaacccactccctgcacagcccaggatacccagccctgctcatggccagaggccttgcttggacagctattctcgatggaccctctggagtggacagtgggtgattcagccagaggccgcagggcctgccctgtcctggcagagccaaattggtgacagtgcccatctgctcccacaggggccctaaccacccaggatgaaaatggccagaccaagcgcaagttgcaggcaggcaagaagagtcaggacaagcagaaaaagcggcagcgagaccgcatggtggaaaggtaaccagcttccctccacccctctgcctctgcctcgctgtggggctgccgccaggagagcagggccatagctctgccagctcgccgccctctggcctcccttgggagccgccacctgctcggccgtgcatggaccctgcttcccgccaggcccagctcccaaggcctgactcatcccctgcccctctgcggccgcctggcgaccgctggcgtctgtgggccgagacctgacaccgctcggcaccgttgctcagaagctctggcgctaggtcactcggcgcacgaaccccaaggtgcactgggggcctgatgcccctgagggagggggccagctcatcagagactcaaggtccaaggcgcctgtgccgccccagctagctgccaagaggccaccgccgtgcccaggagagatggcagcacctgtgggctgtggcagcctcgggcctgccttctgccctgcccgccggccctgtcaggccgggcctgtctgcggctgagcccttcacgccccttggtcgggtctgtctgccctcagggctcccgcactggcgcttgcctcctccgcctcagactcttgctcttgctggaccttcctcagcctcgccggcgcccggcccctgggctctccagacaaagctgaccccgtggcccagataaggacgtccggcagaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283499 - DNA, 1349 bp, Homo sapiens
cggtaccagatgagcagagaactcccccagatcccagaaggaagatgcagcaccttttcgggccctgcctcgggactgcgtactccactctgcacctcagggccacctggctcacgccagggcatccttccttccggtccccacctgggccaagtgcacacgctcctgcccagccttggtagcgaggccctccagcaactttccagcgactcgttgcctgttgcagcagctgctgtctcaggcttcagcctcctgcctgtgggaaggaagagctcctcccctgtcccctacgttgcagtaactgcagcctgcagactttctggccctttctactcccgaccccactggtcccagcctgtccctctgctgggaccgtacttcagaggcccgtgagcaaggcctgtttcagggcttgtgtctgggttgggtgaggcggcagcactatcccctgggacacttgcagcctcagcccctcgtttccttcctgtggcaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccagcaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283500 - DNA, 960 bp, Homo sapiens
cggacgcgtgggtcgacccacgcgtcgtcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggcaagtgtcattcctgtgattgctgtcctgtcccttggggttgtcctggctgtgtttctctgccactgccctgcttggccaaggttgggagtggggagggggcatgtttctggggttacctactccttaacaggaggccctcatcagaatgaccagggcccatctagcttcagtggctagggtcttctctctctgtgacagaagatacccttgtatctgtgtttgtctctgtctctgtctgcctcccctctgcctgcccccaccatctgtctgtctctgtctccctcactgcaggctacgagggctatggctatggctatggctatggccaggataacaccaccaactatggaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcccggagcggccggccaatggcctcaggctatgggcgcatgtgggaagaccccatgggggcccggggccagtgcatgtctggtgcctctcggctgcctccctcttctcccagaacatcatccccgagtacgggggcggagcccgcgtggccgaagctggaaaccaaacctaataaagttttcccatccca

SEQ ID NO: 283501 - DNA, 537 bp, Homo sapiens
ctccctcatggtggcccgcagtattctcaacaacaagctcatcagcaagaagctggagcgctacctgaaggtgaggcactggtccgggcctgccctgtccccagcttagtccccgcctgtgctccctcccttcagtgtccgcgcccctccccacagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatccca

SEQ ID NO: 283502 - DNA, 195 bp, Homo sapiens
cgtccagttggcggccgcctggccggtggcgcccgggccgtggaaggtccagtcgtggctgacggcgggcaccaggcgcgcgggccgcatcttgcggcggtcgtggatgaagaagagcaggcggaggtagacgaggtgcgtggcgcccaccaccacggccagcagcagcaggaagcccagcgcgccgggggcgcc

SEQ ID NO: 283503 - DNA, 6128 bp, Homo sapiens
gcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 283504 - DNA, 6174 bp, Homo sapiens
cgtccagttggcggccgcctggccggtggcgcccgggccgtggaaggtccagtcgtggctgacggcgggcaccaggcgcgcgggccgcatcttgcggcggtcgtggatgaagaagagcaggcggaggtagacgaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 283505 - DNA, 6208 bp, Homo sapiens
cgccggagcgcgcagcgcggccgccgccgccagccccgccgaggcatcccgcaccgcctgggcccggctgggctgggggcgcctccgcagcagccgcggggtcgggaggcggccgggagggaggcagggcccaggacgcaaggtggcgacaagtcgcgtttggccccaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 283506 - DNA, 5911 bp, Homo sapiens
tcctgctcctgcttgcctagatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 283507 - DNA, 6076 bp, Homo sapiens
ccaacttttaaagcagtattttataaaccccatgaagagcatcatgcttttgaaggtggacgtggaaaacactaattgcactctgtaaagaattctttgtcctttgctgattggctttgggaacggtcttaacaggagggagagtgaagagaagacttgccgaagccgatgctggtcaatttagaatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 283508 - DNA, 6298 bp, Homo sapiens
gcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgtttacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatgaagtaaattgagtgtttctgagttttctatagaaaatttatgctacctctcatcttttcacatacaaataagcaacttttaatgaaggcttagggtgaaaattttaattttagcactttacattacatgatgaatggtgaatattaaaggactttgaacattttaataaa

SEQ ID NO: 283509 - DNA, 3562 bp, Homo sapiens
gcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagatta

SEQ ID NO: 283510 - DNA, 2590 bp, Homo sapiens
gcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgattttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagta

SEQ ID NO: 283511 - DNA, 879 bp, Homo sapiens
ttatgattattttttcccgcccaccgtataagggacggagcagacgaccccctatccacaaatttatgggatacttcatgttgcccatgctgttctcaaattcctgggcttcatcaatcctcctgccttggcctcccaagtagctgagaccacctacagtcatgatccactgttgactctagattgaaggatcctattggacagataagccactatttagggaagtccagtaacctgcctgaggccacataaccaggggacagcagagcccagggtcagcatccatgcctgctaacttttccacttcccactgccctcagtacacctcggcctggcaggcttcaggatgacctccgacctctgggagtgcaagttcctctgggatagctgtgagagacccaaactcacctcttctaaccgtgtgcgcttctcagaaggctctgacccatcactgtcatttcctgaatgctcttcatcctcctcttcatccctgaagatgtcttcataggcgggaacttcaaggtcatcatcttgtttaatgagtaatttgatctaagttcaaaacaaaaaggaattaagcctctcctctttctacggaaaactatacaatatgttcttctgcagaatcttatcatttcctaataagctgactcagtttcctgttcatacaaatagctacctatttaacaagagttccaggcttctaaggaattttcttgttttcattaccagtgaggcaccagagttacaccatacgtggtatgcagaaattatgaaaatctgaaaacagttctttgagaaccatctagtctacttaagtctggaaacacagcatcctcttacgtcatacaccaataaaatgaacgccccacaaaaagg

SEQ ID NO: 283512 - DNA, 669 bp, Homo sapiens
ttatgattattttttcccgcccaccgtataagggacggagcagacgaccccctatccacaaatttatgggatacttcatgttgcccatgctgttctcaaattcctgggcttcatcaatcctcctgccttggcctcccaagtagctgagaccacctacagtcatgatccactgttgactctagattgaaggatcctattggacagataagccactatttagggaagtccagtaacctgcctgaggccacataaccaggggacagcagagcccagggtcagcatccatgcctgctaacttttccacttcccactgccctcagtacacctcggcctggcaggcttcaggatgacctccgacctctgggagtgcaagttcctctgggatagctgtgagagacccaaactcacctcttctaaccgtgtgcgcttctcagaaggctctgacccatcactgtcatttcctgaatgctcttcatcctcctcttcatccctgaagatgtcttcataggcgggaacttcaagtgaggcaccagagttacaccatacgtggtatgcagaaattatgaaaatctgaaaacagttctttgagaaccatctagtctacttaagtctggaaacacagcatcctcttacgtcatacaccaataaaatgaacgccccacaaaaagg

SEQ ID NO: 283513 - DNA, 607 bp, Homo sapiens
gggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccaggagagaacggagagccagtgtgctgtgtgtcacggtccctggatgaacgtttgtggaactggattgaattaaacaagacgtgcaaagcaagtggttcacgaggtagtgtgggggtgtagggatggggactgacccgggaggcaggacacagcccaagccctgccttggcctcacctctaacttgctgatgaccttggatgattcccttcccatcctgggcctctgttttctcatctgtaaaatgggcagattggcaatgtggcctccaggtct

SEQ ID NO: 283514 - DNA, 6041 bp, Homo sapiens
  misc_feature (4411)..(4411): n is a, c, g, or t
  misc_feature (4962)..(4962): n is a, c, g, or t
gggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggtaggagctctgtcccccgtgtctgtgtccaggacccccgaagcgccgcgcctaggaaccccctagcgctgggagcccggccctgctcgaccacgggctttgggctggaggcgtcatcgtcgccacagcgaacgcttatttggcaccgagtgtccgccaggcatcgctctaagcgctttatacccataactcacttcatctcagccacccggttccgtagaagcgtttcatccgcgttttacagacgtgtgcaggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccaggagagaacggagagccagtgtgctgtgtgtcacggtccctggatgaacgtttgtggaactggattgaattaaacaagacgtgcaaagcaagtggttcacgagattcgattgctgtagggaccccgtgggtgtggaatcagacagtattggtcctttcatgactggcttatttcacaaaacccgatgccgtcgaggtccatccatgctgagatatttacggagcatccccagctgctggatgctgggacccaccagtgggcaagagggccgtgcccaccccttcctggaagagacactcactcagtaaatgcagagattcagtgttggggtaaccccagcacacagccctgagggaggaagcccagtgatttgatcggatttgcttttctcttctgcctcggattctgtccaacccctggaaggacctctgaggtgtcccgtggctggttctaggccccattcaagcctcctcctccaggaagccttcccagtcctgggcatctgtagccagctcggtgtttctcacctggggcctgggacgtctcccattctgaactgccgtgttttgggtttactgttctctggcttttggtcccagccggacggtggcctcttgtgttcagggacaaggcaaggagcatccatgcacccccacagtacccaggctgggtctgtgcccgccaggcccccggcaaagcttggatgatccgggctgggctgttctcctgctgctctcctgctgctggcctcgctgtatcagctgatggccatcgcgcctcctgcacccgtcatcccgccctgcacgcccccgccacgtggatgagctccctggggagttaatggctaatggagtctccgctctctcttgtcaaatgcagccatcatccgctggtgctttaagggactctctcccgtccccaccctattctcaggtggctcctaccgacaccacctaatggtgaaccccaacacgaggacacaggcagtgccctctcaggaccactgtgggtgccaccaggcacgacttcctaaacacccacagagcaaaaacctggaaattcagccgaggcactgggaccccaacctctcccagagtggccccagctccacggcgtctgcatggctctggccgtgagcagagcagccccgacctccgtcctgacccagggcgccggagcgccactgcggatctcaccaccacacaagccagacctgctaggaagcccttcccggccaccagctctcgggcgatgcacacaacagggccttttgaattccctgaggttaaggttccccttgagtctcctgggctacaagcaaatcccccgaggggagaagtccaggctgacacagcctcctgcacccctgccttgggaggccacacctcgtttgcctctagaaccgacgactggggagcactgtttgcagagttctctctctctgggtaagttccggagccacatctcactggatccaccacggcctgggtggacggctctcgtgtgtttatagctgggtccctcgcttgggagctgcctccgggtgggcggcctctccagcctgtttgagtgctccacccggagcaggaagagggccgtgtgctctgggcagtggttccttgggcactgcatggtccttgcttccctccagggcccaccttccctggccgctgcatcccagccgagggcaggccccttttgccagctgaaggcagaaaggccggcagccctggggtggcggcgggcagagaaaccccccggagtggtctccgttcttctaaaagtgatgttgacccccgtgtcgcaggcagctggcagggtggcagttcgatctgtcgttacgggcttgcaccactgcggtctcccacccagggagcagctctgtccaaccacagcgagcctccagctcctaccctctgcctgggctggggcagagcctggggtctgggtgggagaagcgtgactctgggatgagaccttacaaagcaggttcctcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccgggggactgcggcccccagaaaggctgcactctgggagcaaagtggcctgaaaccagagaaaagaacgccgggggatttggcttaaactcgttaaacccaatgaaccctcttgccgaacgatcgcagtctgcgcccggtcttttaatctcgttcgggcctcggggtaatttgtttagctgtgctgatcagctgaaggttaattcaattggacttgggttatttatttgtgcccggatttgctaagtgtcattggaggtacatgaggtctttattatggcggcaagatggcttcattagggtgagggccactccctccggatccgccccctcccgccagctccaggctgaggcagtcttgggaggctggagccctgggaggctggagccccaggtgcagtggctcttgttcctggatgcaggggatatctgagcactgtgctgggagtccagcctcgcccagctctggtgttgatactggacggttctgtcacatgacctatcctaaccgaggctgaaggacctgcttcccaggacccgtcccctccctcagggggacctaaaggcgttttccccaccctgcctcagtgttcccattcacacattgggaacagcaccctgttctcctgcggcctcccaggctgggctttgtagctgcagcccccaccccgcctggcgaccggggcagaaggacgctgaggtcgcagagcgggcagacgggttggccgggcgggcagacctcctgcacggagccgggatccttctcaggcagcggcagatgatggattgcacgtggacactgcctgggatgcgtgcgacttggcagcctgcccctttcctgccctgggatcagacgccctggcgggtgtccttttcctggtcccctgtcctcctagcctggggcggcgtctggagcggggaggctcacccctgtgcccacgtcctcaggccacctgccagtccctgcccaccccggccgcggaggggctgtggagactcagggagttctgggatggcacagagggcccaggctggtagcaaccaaagccgtgggaaatgtgggagggatggcaggtgtcccccgaggagtagcccaggtgccccggaggctgctgagagggttgagagtgcagagacgaggggcccagggaagtcttggattctctcgccatcttcaatgtcggagcccagacggggcaaggcgaggaggagcccggggcgaagacgccacccacattcctccttcccgcaggcttcttctccttctagcccttccaggagagaaaccatcccacaagtccagagtagtggcgtccccggggccatgtctcctgagcaaacactgttttctaggagtccgaggggcctcagccatctaggtcaatccctttgcagaacggtgaaggaatctgaagcccagagagggaaaacaatgcctcctgggtcacacagcccatcaggggcagggcagggacgaacggcgagaaaaggaccagcgcgagaggagatccccagcagtgattcctcagccaagcccagcgtctacccacatccacacctcacagccaccngatggggaaggcaccattgccccttttcaaaggtgagaaaacagaggctcagagaggttcagcaacttctcccacagctacttcgttgtagaactgcagttccaggtgtccccgagctctcccttcccgagccatctgctcctgccctcctatccgagccctggccctcccagtcaaagccgggtagtggctgttcagaagccttggggctagtcaatcccagctgtctcggaccagggccccccccaggaggagaccctgaaggatgcagttgagaatatgtgctttctttggtaggtgatctcaggaattgcaggggaaagagggggagcgtgttagtgtaggctctccggagaagcagaaccaacgcacagaggagatttaggatgaggaatctggtttatgtgactctgggggctgagaaggcccaccatctgtgttgcaagctggaaacccagggaagcctgaggtgtgattcaaactcagctcaggtctggaggcctgagaaccagggcagccgatggtggacatccagtccaggggcaagagangacgagatgtcccggctccagtggcgaggcaggaaatgaggggtgaactcctcctccctctgctgtctgttctattcaagttcttgagggattggattatgcccagccacttggggagggcagtccaccttcctgagtccacaattcaaatgctgatctaatccagaaacactctcacagacacagtgtgtagtctgggcaccccacagtgcacttaagtggacacataaaattaaccatcccagggagtgagatgggtaagggaagatgggccacagtgggtgtgtctccatgcctacccccactgtgggcagctgctggagcacacgcctcaaagtcttccctgagggagagggagctgaggtgtttatatcccagctctgtcaggcattggctgaatgtccacactcctggatcaccgcctctcatcctcatgatgtcccatggtcctcatttcacaagtgagctctgggtacatggggagcatcagtcacaccctgggtcagtacctcagctgtctctcacatgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcctgcatgacagctcagggctcccagagctactgtcccaagagatagaaggtggaaactgccagtctcttaggctaggaccagaaaccagcacccctgcacccacagccttttggtagtgatgaaataaacataagatttatcattttaatcattcgtaagtgggattaaatacatttacaacattgtgtaaccatcggcactgtctatatctaaaactttttcatcatctgcaataaaaactctgtatgcattaaa

SEQ ID NO: 283515 - DNA, 490 bp, Homo sapiens
gggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccaggagagaacggagagccagtgtgctgtgtgtcacggtccctggatgaacgtttgtggaactggattgaattaaacaagacgtgcaaagcaagtggttcacgagttgcaccgctgcaccccagcctgggtgacagagccagacagactgtgtctctta

SEQ ID NO: 283516 - DNA, 5709 bp, Homo sapiens
  misc_feature (4079)..(4079): n is a, c, g, or t
  misc_feature (4630)..(4630): n is a, c, g, or t
agttcgacggagactctcatcgccttccatcatggcgcagaattgagagtcgagcacgtcgctttgttttctgccaaacttagccaagctccggtcttaaaatcttttcgttcctagcgtgaggctttctgtctttgttgcaaatattgaaacctgccacgtcacctcttgcactatttgtttagttctttaagaaatgaaaccttaatccatgtacaatttctaaaagcctttatttcaatattttaagaagttatttcccctggcaaagaagccgccctgttgcccggtgtggagctcgatgacaaagctcatcagcctgagtggaagctcattcattattgctgcgttttcgctcttccaggagagaacggagagccagtgtgctgtgtgtcacggtccctggatgaacgtttgtggaactggattgaattaaacaagacgtgcaaagcaagtggttcacgagatatttacggagcatccccagctgctggatgctgggacccaccagtgggcaagagggccgtgcccaccccttcctggaagagacactcactcagtaaatgcagagattcagtgttggggtaaccccagcacacagccctgagggaggaagcccagtgatttgatcggatttgcttttctcttctgcctcggattctgtccaacccctggaaggacctctgaggtgtcccgtggctggttctaggccccattcaagcctcctcctccaggaagccttcccagtcctgggcatctgtagccagctcggtgtttctcacctggggcctgggacgtctcccattctgaactgccgtgttttgggtttactgttctctggcttttggtcccagccggacggtggcctcttgtgttcagggacaaggcaaggagcatccatgcacccccacagtacccaggctgggtctgtgcccgccaggcccccggcaaagcttggatgatccgggctgggctgttctcctgctgctctcctgctgctggcctcgctgtatcagctgatggccatcgcgcctcctgcacccgtcatcccgccctgcacgcccccgccacgtggatgagctccctggggagttaatggctaatggagtctccgctctctcttgtcaaatgcagccatcatccgctggtgctttaagggactctctcccgtccccaccctattctcaggtggctcctaccgacaccacctaatggtgaaccccaacacgaggacacaggcagtgccctctcaggaccactgtgggtgccaccaggcacgacttcctaaacacccacagagcaaaaacctggaaattcagccgaggcactgggaccccaacctctcccagagtggccccagctccacggcgtctgcatggctctggccgtgagcagagcagccccgacctccgtcctgacccagggcgccggagcgccactgcggatctcaccaccacacaagccagacctgctaggaagcccttcccggccaccagctctcgggcgatgcacacaacagggccttttgaattccctgaggttaaggttccccttgagtctcctgggctacaagcaaatcccccgaggggagaagtccaggctgacacagcctcctgcacccctgccttgggaggccacacctcgtttgcctctagaaccgacgactggggagcactgtttgcagagttctctctctctgggtaagttccggagccacatctcactggatccaccacggcctgggtggacggctctcgtgtgtttatagctgggtccctcgcttgggagctgcctccgggtgggcggcctctccagcctgtttgagtgctccacccggagcaggaagagggccgtgtgctctgggcagtggttccttgggcactgcatggtccttgcttccctccagggcccaccttccctggccgctgcatcccagccgagggcaggccccttttgccagctgaaggcagaaaggccggcagccctggggtggcggcgggcagagaaaccccccggagtggtctccgttcttctaaaagtgatgttgacccccgtgtcgcaggcagctggcagggtggcagttcgatctgtcgttacgggcttgcaccactgcggtctcccacccagggagcagctctgtccaaccacagcgagcctccagctcctaccctctgcctgggctggggcagagcctggggtctgggtgggagaagcgtgactctgggatgagaccttacaaagcaggttcctcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccgggggactgcggcccccagaaaggctgcactctgggagcaaagtggcctgaaaccagagaaaagaacgccgggggatttggcttaaactcgttaaacccaatgaaccctcttgccgaacgatcgcagtctgcgcccggtcttttaatctcgttcgggcctcggggtaatttgtttagctgtgctgatcagctgaaggttaattcaattggacttgggttatttatttgtgcccggatttgctaagtgtcattggaggtacatgaggtctttattatggcggcaagatggcttcattagggtgagggccactccctccggatccgccccctcccgccagctccaggctgaggcagtcttgggaggctggagccctgggaggctggagccccaggtgcagtggctcttgttcctggatgcaggggatatctgagcactgtgctgggagtccagcctcgcccagctctggtgttgatactggacggttctgtcacatgacctatcctaaccgaggctgaaggacctgcttcccaggacccgtcccctccctcagggggacctaaaggcgttttccccaccctgcctcagtgttcccattcacacattgggaacagcaccctgttctcctgcggcctcccaggctgggctttgtagctgcagcccccaccccgcctggcgaccggggcagaaggacgctgaggtcgcagagcgggcagacgggttggccgggcgggcagacctcctgcacggagccgggatccttctcaggcagcggcagatgatggattgcacgtggacactgcctgggatgcgtgcgacttggcagcctgcccctttcctgccctgggatcagacgccctggcgggtgtccttttcctggtcccctgtcctcctagcctggggcggcgtctggagcggggaggctcacccctgtgcccacgtcctcaggccacctgccagtccctgcccaccccggccgcggaggggctgtggagactcagggagttctgggatggcacagagggcccaggctggtagcaaccaaagccgtgggaaatgtgggagggatggcaggtgtcccccgaggagtagcccaggtgccccggaggctgctgagagggttgagagtgcagagacgaggggcccagggaagtcttggattctctcgccatcttcaatgtcggagcccagacggggcaaggcgaggaggagcccggggcgaagacgccacccacattcctccttcccgcaggcttcttctccttctagcccttccaggagagaaaccatcccacaagtccagagtagtggcgtccccggggccatgtctcctgagcaaacactgttttctaggagtccgaggggcctcagccatctaggtcaatccctttgcagaacggtgaaggaatctgaagcccagagagggaaaacaatgcctcctgggtcacacagcccatcaggggcagggcagggacgaacggcgagaaaaggaccagcgcgagaggagatccccagcagtgattcctcagccaagcccagcgtctacccacatccacacctcacagccaccngatggggaaggcaccattgccccttttcaaaggtgagaaaacagaggctcagagaggttcagcaacttctcccacagctacttcgttgtagaactgcagttccaggtgtccccgagctctcccttcccgagccatctgctcctgccctcctatccgagccctggccctcccagtcaaagccgggtagtggctgttcagaagccttggggctagtcaatcccagctgtctcggaccagggccccccccaggaggagaccctgaaggatgcagttgagaatatgtgctttctttggtaggtgatctcaggaattgcaggggaaagagggggagcgtgttagtgtaggctctccggagaagcagaaccaacgcacagaggagatttaggatgaggaatctggtttatgtgactctgggggctgagaaggcccaccatctgtgttgcaagctggaaacccagggaagcctgaggtgtgattcaaactcagctcaggtctggaggcctgagaaccagggcagccgatggtggacatccagtccaggggcaagagangacgagatgtcccggctccagtggcgaggcaggaaatgaggggtgaactcctcctccctctgctgtctgttctattcaagttcttgagggattggattatgcccagccacttggggagggcagtccaccttcctgagtccacaattcaaatgctgatctaatccagaaacactctcacagacacagtgtgtagtctgggcaccccacagtgcacttaagtggacacataaaattaaccatcccagggagtgagatgggtaagggaagatgggccacagtgggtgtgtctccatgcctacccccactgtgggcagctgctggagcacacgcctcaaagtcttccctgagggagagggagctgaggtgtttatatcccagctctgtcaggcattggctgaatgtccacactcctggatcaccgcctctcatcctcatgatgtcccatggtcctcatttcacaagtgagctctgggtacatggggagcatcagtcacaccctgggtcagtacctcagctgtctctcacatgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcctgcatgacagctcagggctcccagagctactgtcccaagagatagaaggtggaaactgccagtctcttaggctaggaccagaaaccagcacccctgcacccacagccttttggtagtgatgaaataaacataagatttatcattttaatcattcgtaagtgggattaaatacatttacaacattgtgtaaccatcggcactgtctatatctaaaactttttcatcatctgcaataaaaactctgtatgcattaaa

SEQ ID NO: 283517 - DNA, 534 bp, Homo sapiens
gggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccaggagagaacggagagccagtgtgctgtgtgtcacggtccctggatgaacgtttgtggaactggattgaattaaacaagacgtgcaaagcaagtggttcacgagggtcttgctccgtcgcccagtctggagtgcagtggcaagatctctgctcagtgcagccttgaactctcaggctcaagaaatcttcccgcctcagcctc

SEQ ID NO: 283518 - DNA, 386 bp, Homo sapiens
acaccacacagtaaacacaaaggaaacccaccgttgctgggccgccttccatcatggcgcagaattgagagtcgagcacgtcgctttgttttctgccaaacttagccaagctccggtcttaaaatcttttcgttcctagcgtgaggctttctgtctttgttgcaaatattgaaacctgccacgtcacctcttgcactatttgtttagttctttaagaaatgaaaccttaatccatgtacaatttctaaaagcctttatttcaatattttaagaagttatttcccctggcaaagaagccgccctgttgcccggtgtggagctcgatgacaaagctcatcagcctgagtggaagctcattcattattgctgcgttttcgctcttccag

SEQ ID NO: 283519 - DNA, 5679 bp, Homo sapiens
  misc_feature (4049)..(4049): n is a, c, g, or t
  misc_feature (4600)..(4600): n is a, c, g, or t
gggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccaggagagaacggagagccagtgtgctgtgtgtcacggtccctggatgaacgtttgtggaactggattgaattaaacaagacgtgcaaagcaagtggttcacgagatatttacggagcatccccagctgctggatgctgggacccaccagtgggcaagagggccgtgcccaccccttcctggaagagacactcactcagtaaatgcagagattcagtgttggggtaaccccagcacacagccctgagggaggaagcccagtgatttgatcggatttgcttttctcttctgcctcggattctgtccaacccctggaaggacctctgaggtgtcccgtggctggttctaggccccattcaagcctcctcctccaggaagccttcccagtcctgggcatctgtagccagctcggtgtttctcacctggggcctgggacgtctcccattctgaactgccgtgttttgggtttactgttctctggcttttggtcccagccggacggtggcctcttgtgttcagggacaaggcaaggagcatccatgcacccccacagtacccaggctgggtctgtgcccgccaggcccccggcaaagcttggatgatccgggctgggctgttctcctgctgctctcctgctgctggcctcgctgtatcagctgatggccatcgcgcctcctgcacccgtcatcccgccctgcacgcccccgccacgtggatgagctccctggggagttaatggctaatggagtctccgctctctcttgtcaaatgcagccatcatccgctggtgctttaagggactctctcccgtccccaccctattctcaggtggctcctaccgacaccacctaatggtgaaccccaacacgaggacacaggcagtgccctctcaggaccactgtgggtgccaccaggcacgacttcctaaacacccacagagcaaaaacctggaaattcagccgaggcactgggaccccaacctctcccagagtggccccagctccacggcgtctgcatggctctggccgtgagcagagcagccccgacctccgtcctgacccagggcgccggagcgccactgcggatctcaccaccacacaagccagacctgctaggaagcccttcccggccaccagctctcgggcgatgcacacaacagggccttttgaattccctgaggttaaggttccccttgagtctcctgggctacaagcaaatcccccgaggggagaagtccaggctgacacagcctcctgcacccctgccttgggaggccacacctcgtttgcctctagaaccgacgactggggagcactgtttgcagagttctctctctctgggtaagttccggagccacatctcactggatccaccacggcctgggtggacggctctcgtgtgtttatagctgggtccctcgcttgggagctgcctccgggtgggcggcctctccagcctgtttgagtgctccacccggagcaggaagagggccgtgtgctctgggcagtggttccttgggcactgcatggtccttgcttccctccagggcccaccttccctggccgctgcatcccagccgagggcaggccccttttgccagctgaaggcagaaaggccggcagccctggggtggcggcgggcagagaaaccccccggagtggtctccgttcttctaaaagtgatgttgacccccgtgtcgcaggcagctggcagggtggcagttcgatctgtcgttacgggcttgcaccactgcggtctcccacccagggagcagctctgtccaaccacagcgagcctccagctcctaccctctgcctgggctggggcagagcctggggtctgggtgggagaagcgtgactctgggatgagaccttacaaagcaggttcctcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccgggggactgcggcccccagaaaggctgcactctgggagcaaagtggcctgaaaccagagaaaagaacgccgggggatttggcttaaactcgttaaacccaatgaaccctcttgccgaacgatcgcagtctgcgcccggtcttttaatctcgttcgggcctcggggtaatttgtttagctgtgctgatcagctgaaggttaattcaattggacttgggttatttatttgtgcccggatttgctaagtgtcattggaggtacatgaggtctttattatggcggcaagatggcttcattagggtgagggccactccctccggatccgccccctcccgccagctccaggctgaggcagtcttgggaggctggagccctgggaggctggagccccaggtgcagtggctcttgttcctggatgcaggggatatctgagcactgtgctgggagtccagcctcgcccagctctggtgttgatactggacggttctgtcacatgacctatcctaaccgaggctgaaggacctgcttcccaggacccgtcccctccctcagggggacctaaaggcgttttccccaccctgcctcagtgttcccattcacacattgggaacagcaccctgttctcctgcggcctcccaggctgggctttgtagctgcagcccccaccccgcctggcgaccggggcagaaggacgctgaggtcgcagagcgggcagacgggttggccgggcgggcagacctcctgcacggagccgggatccttctcaggcagcggcagatgatggattgcacgtggacactgcctgggatgcgtgcgacttggcagcctgcccctttcctgccctgggatcagacgccctggcgggtgtccttttcctggtcccctgtcctcctagcctggggcggcgtctggagcggggaggctcacccctgtgcccacgtcctcaggccacctgccagtccctgcccaccccggccgcggaggggctgtggagactcagggagttctgggatggcacagagggcccaggctggtagcaaccaaagccgtgggaaatgtgggagggatggcaggtgtcccccgaggagtagcccaggtgccccggaggctgctgagagggttgagagtgcagagacgaggggcccagggaagtcttggattctctcgccatcttcaatgtcggagcccagacggggcaaggcgaggaggagcccggggcgaagacgccacccacattcctccttcccgcaggcttcttctccttctagcccttccaggagagaaaccatcccacaagtccagagtagtggcgtccccggggccatgtctcctgagcaaacactgttttctaggagtccgaggggcctcagccatctaggtcaatccctttgcagaacggtgaaggaatctgaagcccagagagggaaaacaatgcctcctgggtcacacagcccatcaggggcagggcagggacgaacggcgagaaaaggaccagcgcgagaggagatccccagcagtgattcctcagccaagcccagcgtctacccacatccacacctcacagccaccngatggggaaggcaccattgccccttttcaaaggtgagaaaacagaggctcagagaggttcagcaacttctcccacagctacttcgttgtagaactgcagttccaggtgtccccgagctctcccttcccgagccatctgctcctgccctcctatccgagccctggccctcccagtcaaagccgggtagtggctgttcagaagccttggggctagtcaatcccagctgtctcggaccagggccccccccaggaggagaccctgaaggatgcagttgagaatatgtgctttctttggtaggtgatctcaggaattgcaggggaaagagggggagcgtgttagtgtaggctctccggagaagcagaaccaacgcacagaggagatttaggatgaggaatctggtttatgtgactctgggggctgagaaggcccaccatctgtgttgcaagctggaaacccagggaagcctgaggtgtgattcaaactcagctcaggtctggaggcctgagaaccagggcagccgatggtggacatccagtccaggggcaagagangacgagatgtcccggctccagtggcgaggcaggaaatgaggggtgaactcctcctccctctgctgtctgttctattcaagttcttgagggattggattatgcccagccacttggggagggcagtccaccttcctgagtccacaattcaaatgctgatctaatccagaaacactctcacagacacagtgtgtagtctgggcaccccacagtgcacttaagtggacacataaaattaaccatcccagggagtgagatgggtaagggaagatgggccacagtgggtgtgtctccatgcctacccccactgtgggcagctgctggagcacacgcctcaaagtcttccctgagggagagggagctgaggtgtttatatcccagctctgtcaggcattggctgaatgtccacactcctggatcaccgcctctcatcctcatgatgtcccatggtcctcatttcacaagtgagctctgggtacatggggagcatcagtcacaccctgggtcagtacctcagctgtctctcacatgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcctgcatgacagctcagggctcccagagctactgtcccaagagatagaaggtggaaactgccagtctcttaggctaggaccagaaaccagcacccctgcacccacagccttttggtagtgatgaaataaacataagatttatcattttaatcattcgtaagtgggattaaatacatttacaacattgtgtaaccatcggcactgtctatatctaaaactttttcatcatctgcaataaaaactctgtatgcattaaa

SEQ ID NO: 283520 - DNA, 5793 bp, Homo sapiens
  misc_feature (4163)..(4163): n is a, c, g, or t
  misc_feature (4714)..(4714): n is a, c, g, or t
gggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccagaagttatttcccctggcaaagaagccgccctgttgcccggtgtggagctcgatgacaaagctcatcagcctgagtggaagctcattcattattgctgcgttttcgctcttccaggagagaacggagagccagtgtgctgtgtgtcacggtccctggatgaacgtttgtggaactggattgaattaaacaagacgtgcaaagcaagtggttcacgagatatttacggagcatccccagctgctggatgctgggacccaccagtgggcaagagggccgtgcccaccccttcctggaagagacactcactcagtaaatgcagagattcagtgttggggtaaccccagcacacagccctgagggaggaagcccagtgatttgatcggatttgcttttctcttctgcctcggattctgtccaacccctggaaggacctctgaggtgtcccgtggctggttctaggccccattcaagcctcctcctccaggaagccttcccagtcctgggcatctgtagccagctcggtgtttctcacctggggcctgggacgtctcccattctgaactgccgtgttttgggtttactgttctctggcttttggtcccagccggacggtggcctcttgtgttcagggacaaggcaaggagcatccatgcacccccacagtacccaggctgggtctgtgcccgccaggcccccggcaaagcttggatgatccgggctgggctgttctcctgctgctctcctgctgctggcctcgctgtatcagctgatggccatcgcgcctcctgcacccgtcatcccgccctgcacgcccccgccacgtggatgagctccctggggagttaatggctaatggagtctccgctctctcttgtcaaatgcagccatcatccgctggtgctttaagggactctctcccgtccccaccctattctcaggtggctcctaccgacaccacctaatggtgaaccccaacacgaggacacaggcagtgccctctcaggaccactgtgggtgccaccaggcacgacttcctaaacacccacagagcaaaaacctggaaattcagccgaggcactgggaccccaacctctcccagagtggccccagctccacggcgtctgcatggctctggccgtgagcagagcagccccgacctccgtcctgacccagggcgccggagcgccactgcggatctcaccaccacacaagccagacctgctaggaagcccttcccggccaccagctctcgggcgatgcacacaacagggccttttgaattccctgaggttaaggttccccttgagtctcctgggctacaagcaaatcccccgaggggagaagtccaggctgacacagcctcctgcacccctgccttgggaggccacacctcgtttgcctctagaaccgacgactggggagcactgtttgcagagttctctctctctgggtaagttccggagccacatctcactggatccaccacggcctgggtggacggctctcgtgtgtttatagctgggtccctcgcttgggagctgcctccgggtgggcggcctctccagcctgtttgagtgctccacccggagcaggaagagggccgtgtgctctgggcagtggttccttgggcactgcatggtccttgcttccctccagggcccaccttccctggccgctgcatcccagccgagggcaggccccttttgccagctgaaggcagaaaggccggcagccctggggtggcggcgggcagagaaaccccccggagtggtctccgttcttctaaaagtgatgttgacccccgtgtcgcaggcagctggcagggtggcagttcgatctgtcgttacgggcttgcaccactgcggtctcccacccagggagcagctctgtccaaccacagcgagcctccagctcctaccctctgcctgggctggggcagagcctggggtctgggtgggagaagcgtgactctgggatgagaccttacaaagcaggttcctcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccgggggactgcggcccccagaaaggctgcactctgggagcaaagtggcctgaaaccagagaaaagaacgccgggggatttggcttaaactcgttaaacccaatgaaccctcttgccgaacgatcgcagtctgcgcccggtcttttaatctcgttcgggcctcggggtaatttgtttagctgtgctgatcagctgaaggttaattcaattggacttgggttatttatttgtgcccggatttgctaagtgtcattggaggtacatgaggtctttattatggcggcaagatggcttcattagggtgagggccactccctccggatccgccccctcccgccagctccaggctgaggcagtcttgggaggctggagccctgggaggctggagccccaggtgcagtggctcttgttcctggatgcaggggatatctgagcactgtgctgggagtccagcctcgcccagctctggtgttgatactggacggttctgtcacatgacctatcctaaccgaggctgaaggacctgcttcccaggacccgtcccctccctcagggggacctaaaggcgttttccccaccctgcctcagtgttcccattcacacattgggaacagcaccctgttctcctgcggcctcccaggctgggctttgtagctgcagcccccaccccgcctggcgaccggggcagaaggacgctgaggtcgcagagcgggcagacgggttggccgggcgggcagacctcctgcacggagccgggatccttctcaggcagcggcagatgatggattgcacgtggacactgcctgggatgcgtgcgacttggcagcctgcccctttcctgccctgggatcagacgccctggcgggtgtccttttcctggtcccctgtcctcctagcctggggcggcgtctggagcggggaggctcacccctgtgcccacgtcctcaggccacctgccagtccctgcccaccccggccgcggaggggctgtggagactcagggagttctgggatggcacagagggcccaggctggtagcaaccaaagccgtgggaaatgtgggagggatggcaggtgtcccccgaggagtagcccaggtgccccggaggctgctgagagggttgagagtgcagagacgaggggcccagggaagtcttggattctctcgccatcttcaatgtcggagcccagacggggcaaggcgaggaggagcccggggcgaagacgccacccacattcctccttcccgcaggcttcttctccttctagcccttccaggagagaaaccatcccacaagtccagagtagtggcgtccccggggccatgtctcctgagcaaacactgttttctaggagtccgaggggcctcagccatctaggtcaatccctttgcagaacggtgaaggaatctgaagcccagagagggaaaacaatgcctcctgggtcacacagcccatcaggggcagggcagggacgaacggcgagaaaaggaccagcgcgagaggagatccccagcagtgattcctcagccaagcccagcgtctacccacatccacacctcacagccaccngatggggaaggcaccattgccccttttcaaaggtgagaaaacagaggctcagagaggttcagcaacttctcccacagctacttcgttgtagaactgcagttccaggtgtccccgagctctcccttcccgagccatctgctcctgccctcctatccgagccctggccctcccagtcaaagccgggtagtggctgttcagaagccttggggctagtcaatcccagctgtctcggaccagggccccccccaggaggagaccctgaaggatgcagttgagaatatgtgctttctttggtaggtgatctcaggaattgcaggggaaagagggggagcgtgttagtgtaggctctccggagaagcagaaccaacgcacagaggagatttaggatgaggaatctggtttatgtgactctgggggctgagaaggcccaccatctgtgttgcaagctggaaacccagggaagcctgaggtgtgattcaaactcagctcaggtctggaggcctgagaaccagggcagccgatggtggacatccagtccaggggcaagagangacgagatgtcccggctccagtggcgaggcaggaaatgaggggtgaactcctcctccctctgctgtctgttctattcaagttcttgagggattggattatgcccagccacttggggagggcagtccaccttcctgagtccacaattcaaatgctgatctaatccagaaacactctcacagacacagtgtgtagtctgggcaccccacagtgcacttaagtggacacataaaattaaccatcccagggagtgagatgggtaagggaagatgggccacagtgggtgtgtctccatgcctacccccactgtgggcagctgctggagcacacgcctcaaagtcttccctgagggagagggagctgaggtgtttatatcccagctctgtcaggcattggctgaatgtccacactcctggatcaccgcctctcatcctcatgatgtcccatggtcctcatttcacaagtgagctctgggtacatggggagcatcagtcacaccctgggtcagtacctcagctgtctctcacatgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcctgcatgacagctcagggctcccagagctactgtcccaagagatagaaggtggaaactgccagtctcttaggctaggaccagaaaccagcacccctgcacccacagccttttggtagtgatgaaataaacataagatttatcattttaatcattcgtaagtgggattaaatacatttacaacattgtgtaaccatcggcactgtctatatctaaaactttttcatcatctgcaataaaaactctgtatgcattaaa

SEQ ID NO: 283521 - DNA, 328 bp, Homo sapiens
ttgcatatggcaaggccaaggctgcgaagagagtgtccaggagaaaccagtcaaatcagcagaatgggtccgcagatgctgggattctaaacagcaatggaggtcacaattttataagataacaacaaaacagtctctgtgaaaatcttgggagaaattccaagcaggagtgagagggaagaaccttcatccagtcaacaacctgtagcggtatccggaatacgcacagcactatgagctacaacaaagcacacggcagcacacagaacacagtaaaaaccttgggaagcttgggctgctcattctaaattgggactcggctcaacat

SEQ ID NO: 283522 - DNA, 4219 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283523 - DNA, 764 bp, Homo sapiens
gtaacctaggctaggtacgaggctgggtggtgacctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283524 - DNA, 1012 bp, Homo sapiens
gtaacctaggctaggtacgaggctgggtggtgacctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaaaaatgacaacaaaaaaaaaaaccgcgggggaaaaagggggggcggaaaaaggtaagaaggaccaggccaagtgtctcggacccttttgggaccaggggaaagcgggccccaaggaggcgtaaaggtaggcgatttgaagagataagagagaacaagaaaattgaactatacaataagagaaacaaagaacatatataatagagagcaaacataacaaaggagagacaaacacatgatagaacga

SEQ ID NO: 283525 - DNA, 1127 bp, Homo sapiens
  misc_feature (887)..(887): n is a, c, g, or t
  misc_feature (889)..(889): n is a, c, g, or t
  misc_feature (891)..(891): n is a, c, g, or t
  misc_feature (894)..(894): n is a, c, g, or t
  misc_feature (897)..(897): n is a, c, g, or t
agaggcattatgtgaatatgaaaagcgctgttttcttgcaggctggtacggtcggaatttcgggactgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcagtaaagngnangancgngagaaggcacggcggtgcaggggacaattaacccgcctataaagccctagtaggagcagtcgtgagcccgggtaaacacccagggcagggaggggcacgaacgccaaagagcggggccccccgagagacaacacagacaaggcctccgagaacagatagggcccaacaccagcaggggaagagccagcagcggcgaaaggcacaaggaagtgaggcgaccgggacaacga

SEQ ID NO: 283526 - DNA, 566 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtgagcgaccaccctcggtcctctgtgcagcatagcccccttccccagcccaccctcttcccagcccaggaccgccga

SEQ ID NO: 283527 - DNA, 3290 bp, Homo sapiens
gttctagaggatccgtgtaatccgtacagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283528 - DNA, 4350 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtagggcaggagacttgaggaaggaagggacccaaggtggggcaggatgagctcttctcttagcgttcaaggcacatgccagaacccaaggtgtcagttaccactccccagccccgtgtgcccctccacaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283529 - DNA, 4123 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggagctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283530 - DNA, 4412 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtgagtgtctgcgtgggtgggggatggtctggatatttcagtgggagaaattccaatcacaggaaaggaaaaaaagatacaatctgagcagagaaccattgattctatcaagtagagaagcccttggatcgtgtctcatttataaatatgatgacacaagagtcatctttctacatgagccctcttttcacaggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283531 - DNA, 4456 bp, Homo sapiens
  misc_feature (4353)..(4353): n is a, c, g, or t
  misc_feature (4356)..(4356): n is a, c, g, or t
  misc_feature (4358)..(4358): n is a, c, g, or t
  misc_feature (4368)..(4368): n is a, c, g, or t
  misc_feature (4375)..(4375): n is a, c, g, or t
  misc_feature (4386)..(4386): n is a, c, g, or t
  misc_feature (4390)..(4390): n is a, c, g, or t
  misc_feature (4400)..(4400): n is a, c, g, or t
  misc_feature (4411)..(4411): n is a, c, g, or t
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcggaaaaaaaacaaacaaaaaaaaaaaaaaaaaaactgtgtgtgggcgcgcccccggggccccgagaaaaggtttttaaaacccatcggtgggggcgcgcggggccccaagaggtacgtggaccggggcccaaanggngnccaaaggaancccggcnaagacccgggngggntccccccaanaaaaaacgccnggggaacccggggtccgacaacccaaggggcggcccaaaggcccc

SEQ ID NO: 283532 - DNA, 3154 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcaatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283533 - DNA, 2119 bp, Homo sapiens
aggtgatcgtcacatcagttccaggccaagagctagaggttgaagtctttgacaaggacttggacaaggatgattttctgggcaggtgagagcataggagtctacgtgaaaaacaggctggggctctttaggccatggagtctggcctccttggttctcaccatctagcttttgtcttaatctttctcttcaacaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283534 - DNA, 4176 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagaggtttggggaaaaacaatttaaaaaagggccaagttatgagcaaagtgcgtaggcgggtacgtcaccgacgagaatcgtaatgtggtactgtacactggtgat

SEQ ID NO: 283535 - DNA, 3992 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatcctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283536 - DNA, 4591 bp, Homo sapiens
  misc_feature (3946)..(3946): n is a, c, g, or t
  misc_feature (3948)..(3948): n is a, c, g, or t
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcggaaaananacagcaaaaaaacaacaaaaacagaaaaccacctgggcgcggccgcgccaggacccccgcaaaaaacggctttcagaaaccccccttcggtgggcgcgccgccggcgcccccagacgggcaacacctgacacccgcggcgccaacggcggtcccaaagagaaaaccccggggccagagacccgacggggctggagtctcccacccgcagaaaaaaaaaccgcgccgggggcgacacccgacgcgggtctgggaaccaacccagaggggctccgggacgcaacacgggggtatccaacacaacgggggccccaaggcaggctgagaatcaaaaatagccccggcggggggtaacagaaacgagagcagacggagtcaaccaaaggaaagacaaaacagccagcactagataccacgaacaacacactatcctaaggacgcacaccacgcaaagctcagagcacagaatagaacgcaagagagagaagactacagacatacagagacagaagatcaagcaaacagacacagcaccacgcgaaagagaaacagaagatcagacagcaaagaacgcacgcaacacgtcgaagctaacaagagaacacaccaggacgaacgacagagcgaagacgcaaagagacaacg

SEQ ID NO: 283537 - DNA, 1057 bp, Homo sapiens
gagagaagacttaacggctaggtacgaggctgggtggcgcctgaattaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283538 - DNA, 2936 bp, Homo sapiens
  misc_feature (2696)..(2696): n is a, c, g, or t
  misc_feature (2698)..(2698): n is a, c, g, or t
  misc_feature (2700)..(2700): n is a, c, g, or t
  misc_feature (2703)..(2703): n is a, c, g, or t
  misc_feature (2706)..(2706): n is a, c, g, or t
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcagtaaagngnangancgngagaaggcacggcggtgcaggggacaattaacccgcctataaagccctagtaggagcagtcgtgagcccgggtaaacacccagggcagggaggggcacgaacgccaaagagcggggccccccgagagacaacacagacaaggcctccgagaacagatagggcccaacaccagcaggggaagagccagcagcggcgaaaggcacaaggaagtgaggcgaccgggacaacga

SEQ ID NO: 283539 - DNA, 2219 bp, Homo sapiens
  misc_feature (2135)..(2135): n is a, c, g, or t
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctggtaccgtctcctcagaggagcggtaccagggatccagtgaaccactatcacgaaaaaaactctacctctctatactaatctccctacaaatctccttaattataacattcacagccacagaactaatcatatnttatatcttcttcgaaaccacacttatccccaccttggctatcatcacccgatgaggcaaccagccagaacgcctgaacgcagg

SEQ ID NO: 283540 - DNA, 1377 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgagccaatttttttgcccaagtgcctaggctgctaactcactgactagaacttaatctggtactttacagttttgcaccaactctgccaagccactggatcttacattaaacatcatactc

SEQ ID NO: 283541 - DNA, 248 bp, Homo sapiens
aggtgagggctggaagctgctggcaccaaggttatagtccctgtgaggaaggaagtaccccacgtgatcctttagaggtgactcacctctgcaatggtttgggacgagtatgtgatgaaggaacatggtctttggagatttcaaaacagcatcatcagaatgagatcctgtctcaaaaaataaaagaaataacatctttcccctatcatcttccaacacaggtgcagctggacctagctgagacagac

SEQ ID NO: 283542 - DNA, 607 bp, Homo sapiens
acggtgcctggttgtcctggtgcttgggacgtggacagtgagaatccccagagaggcagcagtgtggatgccccacctcgaccctgtcacacgactcctgatagccagtttgggactgaggtgagtctatatctggaaaggactagggtctgtttgccccgctaagtatgcaaagcctgtttcagggcagattctgacaggtctctctccctttgccatctggcacccccccgtcccttttgcagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtcagaattgagtggctgtgactcctggttctgccccatttttcccccaatcccaaaagtggtccagaaacctctgaggttcagttgactggggggtccagtcatttgcagaggaaaaggagagaatctttcatctgcactattttctcccactaggtgatcgtcacatcagttccaggccaaga

SEQ ID NO: 283543 - DNA, 166 bp, Homo sapiens
ccgcctgctgactgccccagaactcatcctggaccagtggttccagctcagcagctctggtccaaactccagactctatatgaaactagtcatgagggtatggaaatagaggaggtactgaggtgtgggggaaaggcctgttgattctttggtattaagagtaagg

SEQ ID NO: 283544 - DNA, 403 bp, Homo sapiens
acaaaaggactttcttacagctttaggtctctcttgggtgtgggaaacatagttggggttaggagaaaattggaagttgaggccatacccactcctttctactcccccattcagctcactctctgacaccatgatcatggactccattgctgccttcctcgtgttgcccaaccgattactggtgccccttgtgcctgaccttcaagatgtggctcagttgcgttcccctctgcccagggtatggcctttcccccactagatagatccttctctcaggaaccccttgctgggtccttagtttctcaccatctgattccttcctccagggcattattcgaattcacctgctggctgctcgagggctgagttccaaggacaaatatgtgaagggcctgattgaggg

SEQ ID NO: 283545 - DNA, 4249 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctatggtgacctctgaattgtacccaccacagctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283546 - DNA, 3300 bp, Homo sapiens
ggctggtactggtctggagtgtttgggatcaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283547 - DNA, 3343 bp, Homo sapiens
ccgatcaggttagacactaagatgcatctgacggggattctgttcgagagagactccccaattccactgtagaacctgctccagtctctctgcatctgacaaaagtgacatccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283548 - DNA, 4302 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtgagaccccatccctcctgtcctccagatcgcctccatcccttccctcaggttaccatatcacctacatcctcctgttgtaggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283549 - DNA, 4189 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgagagcataggagtctacgtgaaaaacaggctggggctctttaggccatggagtctggcctccttggttctcaccatctagcttttgtcttaatctttctcttcaacaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcagatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283550 - DNA, 4467 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaaaaatgacaacaaaaaaaaaaaccgcgggggaaaaagggggggcggaaaaaggtaagaaggaccaggccaagtgtctcggacccttttgggaccaggggaaagcgggccccaaggaggcgtaaaggtaggcgatttgaagagataagagagaacaagaaaattgaactatacaataagagaaacaaagaacatatataatagagagcaaacataacaaaggagagacaaacacatgatagaacga

SEQ ID NO: 283551 - DNA, 4240 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagtttgcaacccgaagcctgcttagtatacaacgcccgagctggattcgttacatataaaccagtaatcttctg

SEQ ID NO: 283552 - DNA, 1718 bp, Homo sapiens
tttaagactaacacagtattgtctttctagctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283553 - DNA, 3939 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283554 - DNA, 1013 bp, Homo sapiens
gcctgcttgtccttcttcgtgtaggagcagagagccccatccagacgggcttgcccttcatagaagtccaaggtgcacatggtgttccccaccactgtggtgaactcgctcagctctgcagaacacagcaacagctcctgcaccagcttcttgttaaggtccgttttccggatgacccgcttccccaggacaatctgctcaaactctgccttgaagcaggtatccctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 283555 - DNA, 1509 bp, Homo sapiens
catcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgatccaatttttttgcccaagtgcctaggctgctaactcactgactagaacttaatctggtactttacagttttgcaccaactctgccaagccactggatcttacattaaacatcatactc

SEQ ID NO: 283556 - DNA, 334 bp, Homo sapiens
tgaagaaatatttttgcaaagcaggagtcaagggcatgcaggtaggccagatgtcaggggccacataatagggaatgtttgtcctgcgtttcatgggatatggggaagtgtgaggttggaaagaccaaggctgagaaagtctgggaggacagaagagggacttttctggggaaaggctttgattttctcttcttgcctcagctacatggcgttttgcgggtgatactggagccactcattggggaccttcccttcgtgggggctgtgtcaatgttcttcatccgacgcccggtaagggaaaacaatgaaggggtatggggaagcaggagaaaca

SEQ ID NO: 283557 - DNA, 960 bp, Homo sapiens
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaagatctgctagccctacttttgaagaggaaacttttgaaggaatgaacaaaagagtattcaccacatggagtgcagtgaggcagttccagaactcaaggtaataatgtaagcatattaataatatttaattattaacaattaataattaatcaattaataacatatgcatatgagatcagcaggagtcacactaaaagccaaaaagcatttcaggtgaaaaacagcaagggtaggccagaaaacacaaagaaatcttgactgaaaagtcagcaataaaaaacactattgaataaaaaggaaggctcgatatactagggctggcaggggagccaagcaagtagatccagagccagaatgacagcagggacctggtaggccttgcttgttatctccagcaaccagccccacgcttagcaaacagtattctgcatcctgtatgattgcaggtatattccaaatgtggggatgaaggcaactagtatttacagtccaatgccaccagccatgaggatgacccatcttggctgaaaaataaagaccttaaatctaggaagcggaagatacaacccaggacagcaggaaggggagacccggtatgagaagaactgaggcccaacccagtttagagaggagactgaaggctaaaggaggaaggtttcccaggaaa

SEQ ID NO: 283558 - DNA, 436 bp, Homo sapiens
actgggccaactcttcactgtatgcattagtgattgcagtgtttttttcttcttcagatatttgcatgttcccctgtctctactaaaaaaaaagaaatacaaaattagccaggcatggtggcacatgcctgtaatcacagctactcgggaggctgaggcaggagaatcgtttgaccccaggaggcggaggttgcagtgagccaagatcgtgccattgcactccagcctgggcaacaagagtggaactctgtttcaaaaaagaaagaaagaaattcagctcccacttaaagttcagttgtactctgttattgacaagtaaagtcgattgaagcccagtcatctcctgtatgttgtgtgacttctcataattatctgatcaagagtcttgaagaaacatttacaatttgatgggcaataaaataatttgaaagcaaga

SEQ ID NO: 283559 - DNA, 2304 bp, Homo sapiens
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggacctgggcgacaaagtgagactccagtctcaaaaaacaaaacaaaacaaaaaacaacagttaagagagttctttctggcccatttagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtgatcccagcactgtgggaggctgaggctggttaatcacttgaggtcaggagtttgagaccagctgggcaatatagtgaaaccccatctctaccaaaaaattagccaggcgtggtggcacatgcctgtagtcccagctactcaggaggctaaggcaagaggatcacttgagcctgggagacagaggttgcagtgagctgagatggctccattgcactccagcctgggctacaaagcaggactctgtctcaaaacaaaaacagatacaaaaactgggaacggggtgttatctttacttcaccacatagcctctcctgaattggtggacctggattcctagcttggctcagtccccactggctgtgtggcctttagcatcacctagattctacaaataacatttttctctatttgttttacacatgtcaatctgcctatccatccctctatccattcatttatccattttattaatgtatttcaaagtaagttgcagacatcattacatttcacttctaaacacttcagcatacagctgagttttatgcaagaaacttaagctctcagctgggtacagtggctcacacctgtaatcccagcactttgggaggctgaggcaggaggattgcatgagattgggagtttgagacgagcctggaaaacagcaagacctcatttctactaaaaattttaaaaattagccgagcatggtgggggagggtgaagaaggaggatagcttgagcccaggagtttgaggctatagtgagctatgatggcgccacttcagtctgagtaacagcaagacactattaaaaaaaaaaaaagagccaggcgcagtggctcacacctgtaatcccagcactttggtaggccaaggtgggcagatcacctgaggtcaggagtttgagaccagcctgacgaacatggagaaaccctgtctctactaaaaaaaaagaaatacaaaattagccaggcatggtggcacatgcctgtaatcacagctactcgggaggctgaggcaggagaatcgtttgaccccaggaggcggaggttgcagtgagccaagatcgtgccattgcactccagcctgggcaacaagagtggaactctgtttcaaaaaagaaagaaagaaattcagctcccacttaaagttcagttgtactctgttattgacaagtaaagtcgattgaagcccagtcatctcctgtatgttgtgtgacttctcataattatctgatcaagagtcttgaagaaacatttacaatttgatgggcaataaaataatttgaaagcaaga

SEQ ID NO: 283560 - DNA, 1815 bp, Homo sapiens
ctggccccatatgaatcccccaaatgaatctcgggattgttctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggacctgggcgacaaagtgagactccagtctcaaaaaacaaaacaaaacaaaaaacaacagttaagagagttctttctggcccatttagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtgatcccagcactgtgggaggctgaggctggttaatcacttgaggtcaggagtttgagaccagctgggcaatatagtgaaaccccatctctaccaaaaaattagccaggcgtggtggcacatgcctgtagtcccagctactcaggaggctaaggcaagaggatcacttgagcctgggagacagaggttgcagtgagctgagatggctccattgcactccagcctgggctacaaagcaggactctgtctcaaaacaaaaacagatacaaaaactgggaacggggtgttatctttacttcaccacatagcctctcctgaattggtggacctggattcctagcttggctcagtccccactggctgtgtggcctttagcatcacctagattctacaaataacatttttctctatttgttttacacatgtcaatctgcctatccatccctctatccattcatttatccattttattaatgtatttcaaagtaagttgcagacatcattacatttcacttctaaacacttcagcatacagctgagttttatgcaagaaacttaagctctcagctgggtacagtggctcacacctgtaatcccagcactttgggaggctgaggcaggaggattgcatgagattgggagtttgagacgagcctggaaaacagcaagacctcatttctactaaaaattttaaaaattagccgagcatggtgggggagggtgaagaaggaggatagcttgagcccaggagtttgaggctatagtgagctatgatggcgccacttcagtctgagtaacagcaagacactattaaaaaaaaaaaaagagccaggcgcagtggctcacacctgtaatcccagcactttggtaggccaaggtgggcagatcacctgaggtcaggagtttgagaccagcctgacgaacatggagaaaccctgtctctactaaaaaaaaagaaatacaaaattagccaggcatggtggcacatgcctgtaatcacagctactcgggaggctgaggcaggagaatcgtttgaccccaggaggcggaggttgcagtgagccaagatcgtgccattgcactccagcctgggcaacaagagtggaactctgtttcaaaaaagaaagaaagaaattcagctcccacttaaagttcagttgtactctgttattgacaagtaaagtcgattgaagcccagtcatctcctgtatgttgtgtgacttctcataattatctgatcaagagtcttgaagaaacatttacaatttgatgggcaataaaataatttgaaagcaaga

SEQ ID NO: 283561 - DNA, 1480 bp, Homo sapiens
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggacctgggcgacaaagtgagactccagtctcaaaaaacaaaacaaaacaaaaaacaacagttaagagagttctttctggcccatttagatctgctagccctacttttgaagaggaaacttttgaaggaatgaacaaaagagtattcaccacatggagtgcagtgaggcagttccagaactcaaggtaataatgtaagcatattaataatatttaattattaacaattaataattaatcaattaataacatatgcatatgagatcagcaggagtcacactaaaagccaaaaagcatttcaggtgaaaaacagcaagggtaggccagaaaacacaaagaaatcttgactgaaaagtcagcaataaaaaacactattgaataaaaaggaaggctcgatatactagggctggcaggggagccaagcaagtagatccagagccagaatgacagcagggacctggtaggccttgcttgttatctccagcaaccagccccacgcttagcaaacagtattctgcatcctgtatgattgcaggtatattccaaatgtggggatgaaggcaactagtatttacagtccaatgccaccagccatgaggatgacccatcttggctgaaaaataaagaccttaaatctaggaagcggaagatacaacccaggacagcaggaaggggagacccggtatgagaagaactgaggcccaacccagtttagagaggagactgaaggctaaaggaggaaggtttcccaggaaa

SEQ ID NO: 283562 - DNA, 348 bp, Homo sapiens
aggagaatggcatgaacccgggaggcggagcttgcagtgagctgagatcgcgccactgcactccagcctgggcgacaaagtgagactccagtctcaaaaaacaaaacaaaacaaaaaacaacagttaagagagttctttctggcccatttagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtga

SEQ ID NO: 283563 - DNA, 812 bp, Homo sapiens
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccacctgggcaacaagagtggaactctgtttcaaaaaagaaagaaagaaattcagctcccacttaaagttcagttgtactctgttattgacaagtaaagtcgattgaagcccagtcatctcctgtatgttgtgtgacttctcataattatctgatcaagagtcttgaagaaacatttacaatttgatgggcaataaaataatttgaaagcaaga

SEQ ID NO: 283564 - DNA, 957 bp, Homo sapiens
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggagtcatgctctgtcgcccaggctggagtgcagtggcgtgatctcggctcactgcaacctctgcctcctgggttcaagccattctctgcctcagccttcccattagctgggattacaggcatgcgccaccaggcccagctaatttttgtgctgttagtagagacggggttccaccatcttggccaggctggtcttgaattcctgacctcgtgatccacccgcctcggcgtc

SEQ ID NO: 283565 - DNA, 1440 bp, Homo sapiens
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggacctgggcgacaaagtgagactccagtctcaaaaaacaaaacaaaacaaaaaacaacagttaagagagttctttctggcccatttagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtgatcccagcactgtgggaggctgaggctggttaatcacttgaggtcaggagtttgagaccagctgggcaatatagtgaaaccccatctctaccaaaaaattagccaggcgtggtggcacatgcctgtagtcccagctactcaggaggctaaggcaagaggatcacttgagcctgggagacagaggttgcagtgagctgagatggctccattgcactccagccctgggcaacaagagtggaactctgtttcaaaaaagaaagaaagaaattcagctcccacttaaagttcagttgtactctgttattgacaagtaaagtcgattgaagcccagtcatctcctgtatgttgtgtgacttctcataattatctgatcaagagtcttgaagaaacatttacaatttgatgggcaataaaataatttgaaagcaaga

SEQ ID NO: 283566 - DNA, 1245 bp, Homo sapiens
ggtgcaccaaaatctcagaaatcaccactgaagaacttattcatgtaaccaaaaaccacctgttccccaaaaactattgaaataaaaaaagaacctcatgaatattttttaaaagcctatgggaaaaaaattacaatctaagttatgactattaccaccctttcaccatttctgaaagctcagctgattctatatgaacttctacaacatcactacccagtagaactttgtattacgcaaaccaattattactaggccgctctccccataactcaattctgcctatggactcacttggagtggagtggaacagttgattaaactgcttataggattttctcagatgttcatatatgtaattcacacactcaaaactctgaacaagtaataccttcctatgtacaattaactatatttgtatttttggattggcaggcaaatgaataaaagaacatcttttatttacccgtatctgcgacattcctcatagtatgtttgaaagcccaaatgatggaatccaaaacaagtttaaactgtgtaggtggaatagcaaggaatgctgggaaacaatgagaattgacagcctgaagtagtaagaaaaagttcgttctatgttcaggatattcttcaaagtcctaaaaataagtggtggaaacaaaataatgtttcagtgtctttgttgtgctagacaggaggggaaaagcaaggcttaatccagtataaatatttggagttttcaataaaccacagaagatagaatgcctcctgaaaggtaaacccaagtaaaatacaatccacctctcacggaaaatgaaactgtcccgttacgcacatgagttatcaaattgaaggagaaagacaacctttttaatagagaactcatctaaaccattattaccataagactactactatcacttttgtttttaatttgaaatcaccactacagattacaaaaaaatttaagttaccgtgtaaatgtgtccacttaacgtatcttttatctcttttttctttttaaacagtctcactctgtcacccaggctgtagtgcagtggcgcaatctcagctgactgcaacctccgcctcctgggttcaagagattctcctgcctcagcctcccgagtagctgggactacaggcatgcggcaccatgcccagctaattttttttctttagacagagtcttgctctgtcacccaggctggagtgcgtggcgcgatcttggctcactgcaagctccgc

SEQ ID NO: 283567 - DNA, 920 bp, Homo sapiens
acggagtctcgctctgtcacccaagctggaatgccgtggcgcaatcttagttcactgcaacctctgcctcctcggtccaagccattctcctgcctcagcctcccgaataggcaaatgaataaaagaacatcttttatttacccgtatctgcgacattcctcatagtatgtttgaaagcccaaatgatggaatccaaaacaagtttaaactgtgtaggtggaatagcaaggaatgctgggaaacaatgagaattgacagcctgaagtagtaagaaaaagttcgttctatgttcaggatattcttcaaagtcctaaaaataagtggtggaaacaaaataatgtttcagtgtctttgttgtgctagacaggaggggaaaagcaaggcttaatccagtataaatatttggagttttcaataaaccacagaagatagaatgcctcctgaaaggtaaacccaagtaaaatacaatccacctctcacggaaaatgaaactgtcccgttacgcacatgagttatcaaattgaaggagaaagacaacctttttaatagagaactcatctaaaccattattaccataagactactactatcacttttgtttttaatttgaaatcaccactacagattacaaaaaaatttaagttaccgtgtaaatgtgtccacttaacgtatcttttatctcttttttctttttaaacagtctcactctgtcacccaggctgtagtgcagtggcgcaatctcagctgactgcaacctccgcctcctgggttcaagagattctcctgcctcagcctcccgagtagctgggactacaggcatgcggcaccatgcccagctaattttttttctttagacagagtcttgctctgtcacccaggctggagtgcgtggcgcgatcttggctcactgcaagctccgc

SEQ ID NO: 283568 - DNA, 575 bp, Homo sapiens
tgtctcccaggctagagtgcaacggcgccatctcggctcactgcaacctccgcctcccaggttcaagcaattctcctgtctcagcctcccgagtagctgggattacaggcgtgcgccaccacgcccagctaattttttttattttttatttttagtagagacagggttttgccatgttggccaggcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggggataacatcctgagaagtcgaattcagtcgtccttttaatctccgaactgcgtgctgtgttggg

SEQ ID NO: 283569 - DNA, 588 bp, Homo sapiens
  misc_feature (74)..(74): n is a, c, g, or t
  misc_feature (82)..(82): n is a, c, g, or t
gggcctctgtagaaccttacgacagcattcgtgtggcgctgcggggccagataagtaattgacaccatggatcnattatgcntcgttctccttaatgtcgagaagtctcggtggatcacactgcacttcagatgcatggggactgtcttccatctcagtgagaaagatccgcgcggcagtgaaacgctgcatgcgtgctgtgaacaaatcctgaaatgagaagcttcgtgaaaggctcgactctatgctggagtcgtactcaatgagatgaggtccaatgcgaagtctcgacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgattgaggcagactgcgattctgca

SEQ ID NO: 283570 - DNA, 2440 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctga

SEQ ID NO: 283571 - DNA, 1774 bp, Homo sapiens
caggctgtactggccccaatccctatgatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283572 - DNA, 2613 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggtggagtcttgctctgtcgccaggctggagtgcagtggcgcgatctcggctcactgctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283573 - DNA, 2641 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggtatgataccttgtttcttaaaatctcctttaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283574 - DNA, 3385 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccaggtgagcaatcttggagaagaataacctgttactttgaatttggcttgtaaacgaagcttataaatggcttataacctttataaatgaagttaacatgaaggttgttcccatagtttcttcacagtgattcaatatttatatagataaacagaagaaaataagtgataaccttaccacccagatattaccttgtttatatttggggatatatctcttcagaagtggaattgcttaatccaagagattgaatggatttaatgcaagatctttttcatcttctttttctaataacccagcgtttgagcacgatttagtccttgcactttgaccctgcaattctactcctaggaattattttacagatgtgctcaacatacatcggcacaaagaagtgtgtgcaaggttatctgctgcagcattgtctgtaatcacaatgtgtaagaatttcagtgtcctatagattagagacatatttcagtaatttacggctcattcatggaatggattactatgtcgctagcaaaaagattgaggcaaatctttatgtattgacatggtaacattaagtggagaaaaacaaggaacagaataatttgtaaattataccaccatttgtgtaaaaaaaaaaacatagatgcgtgcagtgcttctagaaggatacacaggaaactgtggactagttgtctctggggtgagagtaggatagagactcagtttttactttattcctttagtatataatatttgaatttttctaccacatacgtgtaatgaatgtataacctgttccaaaaaataaccccctttcctatttcagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283575 - DNA, 1929 bp, Homo sapiens
ggcgagttgccgttggggatcataggccttggagaagggcctaacacgattagtccccgcggtgtgcccacgcacgtcctttcatttaagccactcgtaaacgtttattgagccccgcccttgtggagcttaccgtctaccggaaaagacggtggagtcttgctctgtcgccaggctggagtgcagtggcgcgatctcggctcactgtaagctcagcctcccgggttcacaccattctcctgcctcagcctcccgagtagctgggaccacaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283576 - DNA, 2117 bp, Homo sapiens
ttttttttgagatggagtcttgctctgtcgcccaggctggagtgcagtggcaccatcttggctcacttcaacctccgcccccaaggttcaagtgattctcctgcctcagcagtccacccaccttgatctcccaaagtgctggtattataggcgtgagtcactgtgcccggcccaaatcagacttctttaatgctgaaggccacactttttcccactgcatagcactgcttaccaatctaaatagatttcacaactgatttggtagcctgacccttggtgtcaagctgttcgtccttccactgcttctatcctgggagaagtgtaaagctcatttgcttttgttcttttacaagtaaagcttataaatgataatgtttgtgttttgacattttagtctgtgctaaagacgctgtgagcagtactagcaacacttcacaatttattctaaatctcacaccaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283577 - DNA, 1340 bp, Homo sapiens
ggctagtacgaggcgggtgttgaatcggccgaggctataaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283578 - DNA, 3520 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccaggtgagcaatcttggagaagaataacctgttactttgaatttggcttgtaaacgaagcttataaatggcttataacctttataaatgaagttaacatgaaggttgttcccatagtttcttcacagtgattcaatatttatatagataaacagaagaaaataagtgataaccttaccacccagatattaccttgtttatatttggggatatatctcttcagaagtggaattgcttaatccaagagattgaatggatttaatgcaagatctttttcatcttctttttctaataacccagcgtttgagcacgatttagtccttgcactttgaccctgcaattctactcctaggaattattttacagatgtgctcaacatacatcggcacaaagaagtgtgtgcaaggttatctgctgcagcattgtctgtaatcacaatgtgtaagaatttcagtgtcctatagattagagacatatttcagtaatttacggctcattcatggaatggattactatgtcgctagcaaaaagattgaggcaaatctttatgtattgacatggtaacattaagtggagaaaaacaaggaacagaataatttgtaaattataccaccatttgtgtaaaaaaaaaaacatagatgcgtgcagtgcttctagaaggatacacaggaaactgtggactagttgtctctggggtgagagtaggatagagactcagtttttactttattcctttagtatataatatttgaatttttctaccacatacgtgtaatgaatgtataacctgttccaaaaaataaccccctttcctatttcagtgtaagctggagctacagggcgtcaagggtggggtggaccatgcagcagcttttggaagaattgccttctcttgcccccagaaagaggtaacgcttgataccagatcgtttgagctttctgactagctagttcaacccagctaagaactttgtccttcccttcttgaggtcctttttgattgtggctttagtatcaagttcagcagttgtttcaagagcagctgagataataaattcaaacaaatggcgccttggttctttatggtatctgatactcctctaggactgacgagggccgtgtcctgagtagtgtgtgacccctggctcacgttgcctctgttttcctcaagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctga

SEQ ID NO: 283579 - DNA, 1643 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactggcaaaaaaaaaaaaaaaaaaaaaaaaatttgtggggggcgcctgggcccgaaaaagttttttaaaccacacttcggttggggcgggcccagagttaggggactgggcaacggggctccaaggagaaccgggcaggaatggggcggcttccccaataaaaacgcccggggaccggcggtccgacaatccgtgggtcggcgctccggcctaccagggcagcgatcgtatagcccgccgcgtggggtgagacagaagcgagacagacaaaacgaagagacagagaaaacaaccccacaaaaaagcacgaagacaaaaacacaagaggacaaaacaaaaacaagaaaca

SEQ ID NO: 283580 - DNA, 1237 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggtatgataccttgtttcttaaaatctcctttaggctctgactacacccggataacagaagacagtttctcaaagtgagtataaagcagtggaattaattaaggaggcagtaaattagggaggcaacttcaggagcgtcgggaacacatactgtttctctgcactctcatgagtataaagcagtggaattaattaagaaggcagtaaattagggaggcaacttcaggagcgtcgggaacacatttctctgcactctcatacaacacctgtgggacac

SEQ ID NO: 283581 - DNA, 2723 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtgataccagtctctaagtctcatcatgtaaagtggtggccaggttcagatttttaaaaataaacttaggagattggaagggattgactcagaggatcctggttcccaaagaacacatagagaattacttgtaaatcgtaacctc

SEQ ID NO: 283582 - DNA, 2568 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283583 - DNA, 2507 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283584 - DNA, 2445 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagttgtttttttgaatcaaggggttgtggagcctacatgtaaatacaagtgtgccttgagttaaatctccgggaagacttagaacggccgtgttgccagagctctcctagttagcctgcaggactgtctgaagtccgtgtccgtctgacatgttaccggaattaacaaacctagggacggtgagtgctccttcatgtggctttctggctctctcacctgccactcagtgccgctgtgacttagcagccagagttttcaggagacctccaacgtgtccgttgaaattcagggtaagagttgagaagtttccctgtttgttctaagagttcttaccccaacctcaggggaaatcaatagtaaatttactctgacttcaatgataataaagaagtgcccttgcctcatcctctttatataaagcaatagagccacatggttcaaaaa

SEQ ID NO: 283585 - DNA, 2547 bp, Homo sapiens
ctgaaagttcagtcctctaatcatttgtctttctggtgaccagccccatcctgagtctatgtagaggccccactctaagtcacttcattagcataaactcaggtgtgactgaaaggggctcattatgaatataacaaaagatattcctatcaggaaattccagaggttttgggagctctgagacaggaaccagggacaatgaccagatatgtttcatattatgccacaaatgcaaataagtacatgctctagatgaagcagcggctttccagtatctttttttttttgagacagaatctcactttgtcacccaggtgggagtgcggggtcattatcctggctcactgcaacctctgtcttctgagttcaagcaattctcctccctcagcctccctagtacgtgggactatgggcatgtgccaccatgcccagctaatttttgtatttttagtagagacggggtttcaccatgttggccaggctggtctcgaactcctgacctcaggtgatcctcccgcctcggcctcccaaagtgctgggattacaggcctgagccaccacgcccgtccatctcttaagcttagtaccgtgacaagttggaacagtccaaggcctattaggaatttcatgcttgttgattgatagtcaaggaaataacaggtcagttggagaactgtctttaggattctgttccttgctttacagaaaaggtgaacaaatctttccttcaggtagatgctggatagtctttggagcttgtagtagggtcccatgagcactgcccacagctgctttctgtaccatctgaggtcatctcatccttaagagaacttttaggaccagacaggaatgctcatctctctgtgcccagtagttctctgggggtggcctgaggctgacttgtctgtagtcactgagttcatttacttttattttctaggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctg

SEQ ID NO: 283586 - DNA, 1735 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcagcattgtggtgtcctggcgataagtgacagggtgcccacaataacaatcggtggaattgagaccgttcccccctacggcc

SEQ ID NO: 283587 - DNA, 2043 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggcacatgaacaactcggccttagtcgggggcatgacgcactctcgagcaacctttctaagatggatcccagagggacgccactcgtcggcatgctgcacttggcagcagattcaacgtgacgagtggttggccaacaccaccaatcactgccctacagcgttcagggttaccgcggaacgacagttgatggcacgcagaacagacctctggtgatatccatggccccatgccaccacttgttgatcggggccacttgtacgctgtggttcaagcgtcatcgccgacagttatacctggcctccgtttcctggaacttgtgggctgtacaccggtatcacggggccacgggacaggcatctgtgcgctatcgtgtcgtagaacttcgcgggatactttccgagagctctcttgtgagcagcgctcctgtactgttaacatctctacgaaaactgcacaacgctccaatcaccgta

SEQ ID NO: 283588 - DNA, 1284 bp, Homo sapiens
tttttgaggttttattatttttatttatttttgagactgagtcttgctctgtcatcaggctggagtgcagtggctcactgcaacctgggtgacagaacaagacaaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagtgtctgaaatgagcctgcgaccttccagcaggatcttcccttgtttttcccgaaatggcctggactttactattgtcattacactggctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggacacaccactttcactgggctccgccgcagcgcacggacccagcgcctcgctcaaggtcccaagcctggaccacctgcagcaacggtcgcacgacaaacctcgcgggtctcaccagcgccgccatgttccctgagacccgggctgcgtcacgaaagcgcgccgtcgggcataggtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgattgaggcagactgcgattctgca

SEQ ID NO: 283589 - DNA, 407 bp, Homo sapiens
gctctgcacttcgtattcaaagtgggaaaccgcttccagacggcgcgtttctatcgggacgtcctggggatgaaggtgcaggccggggccgacaggggctggcgcgcgaggctggaaccggcgcccgagccggccctggcggagggaggggaaaatgggtgtgtcgtgaacctaagccggagggtgtccgaccttaggccctgcgcggtgttcagcttcaggagcgtggcgagttgccgttggggatcataggccttggagaagggcctaacacgattagtccccgcggtgtgcccacgcacgtcctttcatttaagccactcgtaaacgtttattgagccccgcccttgtggagcttaccgtctaccggaaaagacggtaaataaaatgttatataatgctttcta

SEQ ID NO: 283590 - DNA, 2812 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283591 - DNA, 1632 bp, Homo sapiens
ctcctaggatctatccaagagaaataagtgcagattcccaccacccaccgaagacgtgttcatagtacctgtatgtataggagccccaaactggaaacacccatcagtagtaaaatgggaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283592 - DNA, 1567 bp, Homo sapiens
ggtttatgtgttccgacgtattgaaagtcgaaagacacaaggtcaggaactccgaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283593 - DNA, 869 bp, Homo sapiens
cggtgctcgaggcggaggggaggaggcggggaaggcgaaaggaggggttcggaggagagggttcgatctccgtacgcaccagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacatttgcggcaaacggagttggtctttagagaaattattattggaggaaagatacccataagtacagcaatgttttcaggttgttgtgcgtattcattaattgtattatttctaataatagataacattcgggagtgggtat

SEQ ID NO: 283594 - DNA, 2333 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggcccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283595 - DNA, 3282 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagattgaagccgacgccttgaaagtctgtccagagtaaagttgagccagggtgtggctctcgtctccacccatctccctttccctcgcgctaagccctcaggctggcagctgctttcacccagagtcctcatttgcatcttactttgctctcccgccctttgccttttctaagtggagcgtcctgatccatgatcaggagacgtatttttaaaaaggatcgtttgattaaatgggtactcttgaagaaatatcttcaagtccttgaacactggggatgaaatattgtcaagattaaacaaaatgcgaaacacccaccattaaaaggagacagtgaaaagtgcatataattaaaataggccatgttcaatggccttcatccacaaataaagatgtgctgtccaccaattcctctacacagaatcttgagggacagagattttcatcgcatagtccaaatttcttctttcatagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283596 - DNA, 2919 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagcgtttagtgggctacagatggcatggcatctaaaaccttacaatgcttgattttcatacagaagacactttggccagttgatgtgggttttacctcttcataaaatgagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283597 - DNA, 2862 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggaattatctgtattagcaggaaattttcccttatgctgtaagttgcaaaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283598 - DNA, 1783 bp, Homo sapiens
cggtgctcgaggcggaggggaggaggcggggaaggcgaaaggaggggttcggaggagagggttcgatctccgtacgcaccagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283599 - DNA, 2377 bp, Homo sapiens
aaggtcccacacatttgtaaatcaggagtcaacttttgttcatatactgagcaaggttaaagaatcagaataggtttataatgttccataagaaaactgtaaagaggggatacccccaaattgaggcaagtttcaaaagtgcatggcgtggaatgaaaggaatcacttagtactaaataataaagatagcaaggtatgatttatgaaattaaatgaaaaatctgatgaactttttttctttttcgaagcggggtttcactctgtctcccaggctggagtgcagtggtgcaatctaggcacactgcaacctcaaactcctggccccaaaccatcctcccacctcagtctcccaaaacactgtgattgcaggcatgagccaccttgtctggcctcaagacatcttaagagtcttgtgaaatgttttgaccatgttttctgtagttgaattttataaaactgaagatgttatgttcttgttgaatttacccttttttcccacgtattatcatttaattaaaatattcaatgatatgacttctagttgtgctttagtaatgtacacttatttctacataagttagcttgcaataagttcaaatctcttaaaatatcagatccatataatttagaagatgagaaatatacatgatctgaacatgagagtactggtttaatttaaattgttttggtgttaataatgtactttttcccctctcttttcctgttaagggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283600 - DNA, 327 bp, Homo sapiens
gaacatatatgtgcatcattttaacagatactgccaaactgctctccatagaaattaaaacaatttactctccaaaacagccatgcatgaagagtttctgtttattcacagcctcagcatcagagaatgttatccaactttttgatttttgtcagttgatgaaaaaatgatacctaatttctctgattattaatggtattgaattgagcatctgttcatgttttaacatttgtagtttttattctgcaattgcatttaactttatatttggattttggattgctggtctttttttttattggcttctaggaattatctgtattagca

SEQ ID NO: 283601 - DNA, 447 bp, Homo sapiens
tattgtcaagattaaacaaaatgcgaaacacccaccattaaaaggagacagtgaaaagtgcatataattaaaataggccatgttcaatggccttcatccacaaataaagatgtgctgtccaccaattcctctacacagaatcttgagggacagagattttcatcgcatagtccaaatttcttctttcataggtaaaataattagcctctcagtttttaagtttgtatccaggtgtagtgcacggagttctgttgcagaaagtatagtccactcgtcctctaataattttgtttttctgtctgaagttgaaatattggccggttgaagtttattgcaaggcatacggttgtataatttagttggctagtgtatattatagtggaaagaagcagagttaagtttaaatttccattctcactagtttggacctttgccaagttactgaaa

SEQ ID NO: 283602 - DNA, 2142 bp, Homo sapiens
gtgtcccagcttcccgagcttagacgctccatcaccgtagggggtggggcagtgggggtctgccaccttcaccctccccgcccgagttacgtacgccccacaaacctgaggccgccaggggtagggtggagggggcggggggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283603 - DNA, 2561 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcacggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283604 - DNA, 2760 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283605 - DNA, 2758 bp, Homo sapiens
  misc_feature (215)..(215): n is a, c, g, or t
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagagntgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283606 - DNA, 2067 bp, Homo sapiens
tatcataaagtcacaaaaccatgataagtggaattccattgcagaagacattgaactgtgcttatttggaagaatagagaaaggaactgaactccacctagtatgccctttagtgtttaccactaccttagggaataaacagtactctcatcctatgtacggtatatagctgttggctcccttagtggtcaacacattaatttgcttgctgaaggtcacatagctggtaaattgaatcagaatttgaacccagttctttgtgactccagagcactttccacagctccacaatgccttcacagcccttgagttacttttcaaattatagtattgctttcctacctaagtccctctttgtatttgcagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgcttctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgt

SEQ ID NO: 283607 - DNA, 1471 bp, Homo sapiens
cgatatttgtggttctggcttttctactataatattggaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283608 - DNA, 458 bp, Homo sapiens
cactggtaccggcaaggtatgagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagtaacagctaccttgcccggt

SEQ ID NO: 283609 - DNA, 346 bp, Homo sapiens
aaaaaaaaaaaaaaaaaaaaaaaaggaaaggaaaagaaaatgattgtttgtttgagaaccgggcttagaagtcaaatgatttgcccagagcctcatgatcggtaagtggccgagtgagagactggttcttgggttttctgaccccgactgccattccttttttttctgctgcagccgtgtgtctgggtggctgacggatgacacagctgagccattctcctcatcaggtgtgactgtcgttgaagcagcgcacacttctcgggggcctgtgcacctcagtccctcctgcttcctgtcccttgcaccccctgcctctatgtcgttttcgggatcctctagacagcca

SEQ ID NO: 283610 - DNA, 4231 bp, Homo sapiens
gaaagcaggatgcacgaggtggcggccctgcagcccttgagtggggcctcattcctggagatgcagcaaagagtttgccggtttgggcttgtggagggaaagtcagtctgaatgtagatggaactgtaggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283611 - DNA, 4186 bp, Homo sapiens
gaaagcaggatgcacgaggtggcggccctgcagcccttgagtggggcctcattcctggagatgcagcaaagagtttgccggtttgggcttgtggagggaaagtcagtctgaatgtagatggaactgtaggtcgcctggtcggcgctctggatgcagtgttggattccaatgcacgggtcgctccatttcgaattctgcttcaagttcccggctcccaggtttattctcccatagcatgtggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283612 - DNA, 4655 bp, Homo sapiens
gaaagcaggatgcacgaggtggcggccctgcagcccttgagtggggcctcattcctggagatgcagcaaagagtttgccggtttgggcttgtggagggaaagtcagtctgaatgtagatggaactgtaggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccagggttgccctcatccctcttcttgtagcagccttgtcttttcccttcgtccaatgaattatccccaaactcactgcctttagaggacagaagtgctcctagtgggggtgttgctgggtggctgccccttgcccccaccaccaagttccttcctcctgtttgctgtttcacgggtcctcttagagcagaagtcccccagttaccacccactggctctccaggggaatctcttgctttccagttttgtatggaatttgcttagtggaattcctcacccccttgctcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283613 - DNA, 2199 bp, Homo sapiens
agatttagtgtatttatttctagagtactttatgtgtgcatggatatatttcagttttacaaaatgggatttcactacatacattttttccaaatcagtattagcagtgtccttctatgaatgtgtatgttgttaattacaacagtctccacatacctctgggaaaaggcacacttggtgtgggggacattttattttctctgggtatccagacagtgcttggtgtgcatttgggttcgtggaccctgcaaaaactacagtccacaggctgggagctgctggcttagcctttagttgcctagaaagctacattactgtcagttttggtaaggcagaaaatttgtttaatttaaacctctcatctttttttaagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccagggttgccctcatccctcttcttgtagcagccttgtcttttcccttcgtccaatgaattatccccaaactcactgcctttagaggacagaagtgctcctagtgggggtgttgctgggtggctgccccttgcccccaccaccaagttccttcctcctgtttgctgtttcacgggtcctcttagagcagaagtcccccagttaccacccactggctctccaggggaatctcttgctttccagttttgtatggaatttgcttagtggaattcctcacccccttgctcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283614 - DNA, 3616 bp, Homo sapiens
cgtcgtgccggaattcgtcgtcgtggtgccggaattcgtcgtggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccagggttgccctcatccctcttcttgtagcagccttgtcttttcccttcgtccaatgaattatccccaaactcactgcctttagaggacagaagtgctcctagtgggggtgttgctgggtggctgccccttgcccccaccaccaagttccttcctcctgtttgctgtttcacgggtcctcttagagcagaagtcccccagttaccacccactggctctccaggggaatctcttgctttccagttttgtatggaatttgcttagtggaattcctcacccccttgctcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283615 - DNA, 2498 bp, Homo sapiens
tatgtgtggatggtgccgaggtatgtgaggactgtgcgacagatgatggcaggctgatgatctcatagtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccagggttgccctcatccctcttcttgtagcagccttgtcttttcccttcgtccaatgaattatccccaaactcactgcctttagaggacagaagtgctcctagtgggggtgttgctgggtggctgccccttgcccccaccaccaagttccttcctcctgtttgctgtttcacgggtcctcttagagcagaagtcccccagttaccacccactggctctccaggggaatctcttgctttccagttttgtatggaatttgcttagtggaattcctcacccccttgctcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283616 - DNA, 3488 bp, Homo sapiens
gaaagcaggatgcacgaggtggcggccctgcagcccttgagtggggcctcattcctggagatgcagcaaagagtttgccggtttgggcttgtggagggaaagtcagtctgaatgtagatggaactgtaggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccagggttgccctcatccctcttcttgtagcagccttgtcttttcccttcgtccaatgaattatccccaaactcactgcctttagaggacagaagtgctcctagtgggggtgttgctgggtggctgccccttgcccccaccaccaagttccttcctcctgtttgctgtttcacgggtcctcttagagcagaagtcccccagttaccacccactggctctccaggggaatctcttgctttccagttttgtatggaatttgcttagtggaattcctcacccccttgctcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaaactgagaaagaattgcccaaaatgagccaggtatggactttcttcagtgcagagaattaactttttttttttttttt

SEQ ID NO: 283617 - DNA, 517 bp, Homo sapiens
tttatttcccccatgccactttccagctgatcaagcagtattttttttaaaaaggctatcttttacccattgaattaccttggtctaaaagtcagaatcaatgaactaagcatggacgcttttctggactcaaattccatctctttgttctggttacctcagagtgattttaatttcagactgaccttagagagtgagtcctaccccagccagagccctgtgccctttcttttccaggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcct

SEQ ID NO: 283618 - DNA, 303 bp, Homo sapiens
agcagctggccgacgtgacgctgcgaaggctgctggataatgaggtctttgacctcgaccccgatctgcaggagccgagccagatcaccaagaggtgaaagtgactgttctagagtgtctcccacccgcacgggggacccataagctgtgcccatcccttatgtacaagtgcttttgttagccttggttatgttagatttaaatttcccttgtggcataatccagatttttgtatgtcgttaatctcgacagagatatgacagaaatgatgattactcatttcatttatgcagtggacttcaa

SEQ ID NO: 283619 - DNA, 4572 bp, Homo sapiens
actcggccggcagcggaccgcagccaccagccgcccgcgccctccagccccgtccgggagtccccggcccgctgcggtgccgtgagtacctccaaccccctgcgccccggaggaggccgaggggcttagccaccagggctcggaagtgggggccgaatccggtgcgagacccaaggagaggggagcagagccggagttggggagactgtggctgaaaactgtgtcttcctggagactaggctggcattttgactttggggttgctgaaaagccaggagtcaaaatgactgagcgctttgactgccaccattgcaacgaatctctctttggcaagaggtacatcctgcgggaggagagcccctactgcgtggtgtgctttgagaccctgttcgccaacacctgcgaggagtgtgggaagcccatcggctgtgactgcaaggtgcaacattagaggaaatcaatcagcactgggactggctggaacaaaatctcctccacaccttgtctgtctttgataataaagatgacattgccagttttgtcaaagggaaggtaaagccgtgtgtctgggtggctgacggatgacacagctgagccattctcctcatcaggtgtgactgtcgttgaagcagcgcacacttctcgggggcctgtgcacctcagtccctcctgcttcctgtcccttgcaccccctgccttcccattgctggctcactgagcagggactgtcatctctgtgtgtcaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283620 - DNA, 1286 bp, Homo sapiens
aggtatgtttaaaaaaaaaaatgacacttccaccctggttctgctgctacctaagacttatttcaatttcagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283621 - DNA, 754 bp, Homo sapiens
actgtcgctgctagaggacggtcattccactgtacagtgtcagtgtggttggtgtatgctggatctctcacctatgaaatctttacttttgtgggttgtttgggcttggatgcttgtaacatctctgtggcatcacatgggccagtcagtaactgccctccttgacccccgagcagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaatttggagacccgtctagagcgtaatcggtaccgagctcgatt

SEQ ID NO: 283622 - DNA, 180 bp, Homo sapiens
ctcggtacccggatattttcttcttccggccctatgctgagcagtaccgcatagacgcccggcagtttgcacacctgtttcagctagtctcgccctggacctgcggggcgctcgttgaagttgacagaagggcaatgacgaatgccctggcaccaaccgctgccggaagaagaaaatgat

SEQ ID NO: 283623 - DNA, 3011 bp, Homo sapiens
actgtcgctgctagaggacggtcattccactgtacagtgtcagtgtggttggtgtatgctggatctctcacctatgaaatctttacttttgtgggttgtttgggcttggatgcttgtaacatctctgtggcatcacatgggccagtcagtaactgccctccttgacccccgagcagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccagggttgccctcatccctcttcttgtagcagccttgtcttttcccttcgtccaatgaattatccccaaactcactgcctttagaggacagaagtgctcctagtgggggtgttgctgggtggctgccccttgcccccaccaccaagttccttcctcctgtttgctgtttcacgggtcctcttagagcagaagtcccccagttaccacccactggctctccaggggaatctcttgctttccagttttgtatggaatttgcttagtggaattcctcacccccttgctcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacaaaccatgctttcaatgttggcttccaagttttttaataagaaactttttgtatttacttggtccttttcttttaccttgtagttaagtgtcttaagctgtagactgtggcagtgaatgggtaagctggagatgttgctgctgcccatccatggtttttgggtggtgcaacactactaggtacttctcagccctgccttgggtgtgccctacggcttcagagacc

SEQ ID NO: 283624 - DNA, 2959 bp, Homo sapiens
gaaagcaggatgcacgaggtggcggccctgcagcccttgagtggggcctcattcctggagatgcagcaaagagtttgccggtttgggcttgtggagggaaagtcagtctgaatgtagatggaactgtaggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagtaacagctaccttgcccggt

SEQ ID NO: 283625 - DNA, 2232 bp, Homo sapiens
gaaagcaggatgcacgaggtggcggccctgcagcccttgagtggggcctcattcctggagatgcagcaaagagtttgccggtttgggcttgtggagggaaagtcagtctgaatgtagatggaactgtaggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccaggtgaaaggggtgtgctctggggcgcagagagtctttagttggtgtctcatgttgtccttcccagggtttcatttgcattcccagtcatctggtcctgagtgttgtcgtgtgaaggcgctgtactcggtccctttccggaaagaaagtatcaaatgagggccaaagggactactcatcttataatcaacggatcatgaggtcaggagatcgagaccatcctggccaacatggtgaaaccccatctactaaaaatacaaaaattagctgggcatggtggcgcgtgcctgtaatcccagctactcaggaggctgaggcaggagaatcacttgaaccagggagtcgcaggttgcggtgagccgagatcatgccactgcattccagcctggcaacagagcgagactctgtctcaaaa

SEQ ID NO: 283626 - DNA, 558 bp, Homo sapiens
gccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcggtatgcctctgtgggatttcgcagtgatgtgctttggggtgtgggtctgtgagcagaacacaaagtggatcttcggagcaggcagatgcacatggtgtaacacttttgtgactggcctgacatgaacttatgattttgaaatatcactctgcaggcccctctcaggatctactttctgaagggggatgggagaggggcccacgctctcaacatacgaggctgttcaccttgctttccttggcatccacgatgtggtggtggcttgttgggagccatgttcctaacttttgtccataaaattaaaatgttttggaaggtatgaggccagacaacattcacaaagttccgtggagctcacatagtcaccagcccagtctttaacact

SEQ ID NO: 283627 - DNA, 1032 bp, Homo sapiens
aagaggaccctgggaaggtggctcccgcctcactcctagagtgaaatcctcgcagccctgccctcgcgggcggagcagagacgccgccgcttggccggttcacgcctgtcacacaaagccgccgagggtcggctgcgcccctggcaaggctgtagggctggggatactgagtatgacaggcgaggtccctgctctcaagaacttacatgggagagaaggggagacaagataaacagatggagcaactcaacccaaaaaggttggtctgtatggtgacggaatgtggtctcccagttttcagcacagcactcattcagctattctgctcttcagaaagcaggagggatgtgccctaaggtggactattgaaatgatgaaagccactgaggaagagccagagaattctcgtagctgtgattagacatcaaccttgggcatgctaaacatttcagcctggacaccctgagaagagccagtgccactggtgacagctgcttctgtgcgggcttttgcttggccagagaggcaggaccttctccctggcattttgaggagtggtgccgggtgggcagtgactgcactagcaacagtctataccaagagaagacctcaaattcccagagaagaaaggcagcgaggccaagaaatgctgccgccgcttaacaagtgaagatgcatactggagaataggaactgaacacgcgaaggagtttcggctttactgccttctctcctagcattgaacagatcttctctgctgttgattattctccatgaatcatcatccatagaaagtgactgaggcaatagagagtgaataatgaatctctcaaatagtcttttgtgtttctgcctggagggttttggaaataacttgcatcttaatctttctgacttagaatcatagaatttgggagctgaaaaggaccttcatcagggcatgtggcctcacagaaagactggaagaaaagatttgtgggtatgagcctctggttcatcactaaaaataggcctagtctaacatatattgga

SEQ ID NO: 283628 - DNA, 877 bp, Homo sapiens
aagaggaccctgggaaggtggctcccgcctcactcctagagtgaaatcctcgcagccctgccctcgcgggcggagcagagacgccgccgcttggccggttcacgcctgtcacacaaagccgccgagggtcggctgcgcccctggcaaggctgtagggctggggatactgagtatgacaggcgaggtccctgctctcaagaacttacatgggagagaaggggagacaagataaacaggagccagagaattctcgtagctgtgattagacatcaaccttgggcatgctaaacatttcagcctggacaccctgagaagagccagtgccactggtgacagctgcttctgtgcgggcttttgcttggccagagaggcaggaccttctccctggcattttgaggagtggtgccgggtgggcagtgactgcactagcaacagtctataccaagagaagacctcaaattcccagagaagaaaggcagcgaggccaagaaatgctgccgccgcttaacaagtgaagatgcatactggagaataggaactgaacacgcgaaggagtttcggctttactgccttctctcctagcattgaacagatcttctctgctgttgattattctccatgaatcatcatccatagaaagtgactgaggcaatagagagtgaataatgaatctctcaaatagtcttttgtgtttctgcctggagggttttggaaataacttgcatcttaatctttctgacttagaatcatagaatttgggagctgaaaaggaccttcatcagggcatgtggcctcacagaaagactggaagaaaagatttgtgggtatgagcctctggttcatcactaaaaataggcctagtctaacatatattgga

SEQ ID NO: 283629 - DNA, 719 bp, Homo sapiens
gaggccgggcaggctgcaatgggggagggctgccatggggccagggcggaggaagcaggtccggcagagctggggagccgaccggccgaagggcatcctagcgtggccggactcacaggaatgcggtccagcccaggagagtccttccccaccagagctacgtgagcgtggcgggagcaaagcccggccggcggggcagcgggaagcgcggcccggccggccgagggggtctggcggggacccccgcgctggtcaagtggccgggtccgctgaaggctccgggagccggggcacggcgcgaggggagggcgcggcccgcgcggcactcactctcggtgacccggctgaggcgcaggacgtgctcgggccggatggtgtccagcgccagcagctcctgctccgtgaccgctgccccgacgccgtcgtcggccgcgtggtggggcgcctgccgccgcgccttcaggcggttcaggacgccgccgcccgccttcttcttctcctccttgccagccaccagcccccccgggcccagccgccgacgccgcggccgcagccttcgggttagacccgctcatcgctccgccgccaagatggccgccgcctccacagcgcgggatgatggcaaatgtaacctcttcacctgcaattccacatctaggaatttaccctacctgcatgcacagagatttgtaatattgacaaattacaataaattacat

SEQ ID NO: 283630 - DNA, 1022 bp, Homo sapiens
gaggccgggcaggctgcaatgggggagggctgccatggggccagggcggaggaagcaggtccggcagagctggggagccgaccggccgaagggcatcctagcgtggccggactcacaggaatgcggtccagcccaggagagtccttccccaccagagctacgtgagcgtggcgggagcaaagcccggccggcggggcagcgggaagcgcggcccggccggccgagggggtctggcggggacccccgcgctggtcaagtggccgggtccgctgaaggctccgggagccggggcacggcgcgaggggagggcgcggcccgcgcggcactcactctcggtgacccggctgaggcgcaggacgtgctcgggccggatggtgtccagcgccagcagctcctgctccgtgaccgctgccccgacgccgtcgtcggccgcgtggtggggcgcctgccgccgcgccttcaggcggttcaggacgccgccgcccgccttcttcttctcctccttgccagccaccagcccccccgggcccagccgccgacgccgcggccgcagccttcgggttagacccgctcatcgctccgccgccaagatggccgccgcctccacagcgcggtaactatggagagcgggggcggggcccggggcccggcggggaaggggcggggagggggcggggcgggggcgggggcgggcgcccggggggctgtggaattccctttcgcacagggtggaccaaggcccactctccccaaacttccatccccaaataactagagctgccatcagcaacctgaggtgcacatgagcagccctgggctgactcctatagcaattcagcggacgacaccatggcagccttcgatccattcagggaatgctgctgctgccacagggttaggagaccgcaggccaggagtgatgggcaggccaagataggcctaactgggtgactgcacactcctgcggggcccggggggcggtgcttcggctactgccccaactttggtcctgccaggtggag

SEQ ID NO: 283631 - DNA, 447 bp, Homo sapiens
cctccgcagggcgggacaagctgagccgaaaccacacctgcagcttcagcgattggtggagaagttcaagtaggcactttctacgaggggaggagtccaattagtggactagcccaagactgaaacagctgattttcgagaacccgcgcgtgagccccggaaccgaaactagcttgaggagcctggagacgccaagggctccatgggaaggggtgggaccggaatttcgacgccttgggataggaagaggagggctgagaaacttcaaaactgatcttagttcaagaaagaagttactattcagtgatcaccgaggctctaacaagtggagcctagattcgaaaccaaaccctgtgacttcaacacccaaacatttacgttcttacgttttactgtacagccttcctcctggataaatcagattaaaattttgaagacatgtatata

SEQ ID NO: 283632 - DNA, 861 bp, Homo sapiens
cctgttctatggacgtgactgtttccaccgagtcgtcctgcaaccgctctcgcgcgtgctcgggcctcagactgtacagcggctctgaccagacgggggaggaagatggagggcaatagtaggtgaaagaactcggagaagccatgatcaggagagcagcagacagtgtgtaggactctgcttcgttaagcaacaacgcgcattgaaactcgagcgggctaaagcgctacggcgagcggatagaggcaaaaagattttgaacgcgaatgtctcctcccgcctacccgtctttcgagtgagttactgagatgctgccgccccccattgggcagaggagctgctgcaagagcgtagagtcctgaagcgcaagggtgtctacatccgaatttcatttcagcgagatggcgtaggacgcctcggtgcccaagaacccaatgaatgttaagtttgaaagcatttctgacagctctactgatttgcctcagtcaggcaattactaaaagaattattgtgcaccttggggtacttgacagcctcccaggagaaggcagcagctgctcaaacgtgcaaggacgccgtctcagtatcactcagtgatggagggaggggggtattatgattttctcctgtctcttggaggttacactgcagtagcgagaactgaaatgcagtacaaggaacaaggataagtgaaatagacagtcagtccgcagatatttatggaacacctgctatgtgtcaggcattgtgctaggttctaggaatacaaaagtgaacaaaacgaagtcccttcccttggaaaccttacattctaagaaaatcgacagaattgaatgtatccaacgcaataaatatatgaag

SEQ ID NO: 283633 - DNA, 466 bp, Homo sapiens
  misc_feature (1)..(1): n is a, c, g, or t
  misc_feature (461)..(466): n is a, c, g, or t
ngacatattcagaacatggcagcttctagaattggttcaatcttctgctcgagtggcagtggccaaaggcctggagccgaccaaggagaggttatctaggtaagaatcatcagtggctgatcatccctcaaagacaaacaactagacaagatgtggctcctgatggaagaacgcaggccaccacctacaaagcaccctggctgcctccctcccccaggaaacaaggcatgaagagaaaaccaacctctcctttctggttgatgatgggaacagcgtattgtaacttcacatcatagaaaagtgactcgaggaagacattggccaccccaatgagactgtgattttcctgctcatcatagaatggatcagcacgtttgaagtatgatcgtattacctgtaaagagattgagaacacacaacttcagaaaaaccatttacaataaatgcattcaacctaaaannnnnn

SEQ ID NO: 283634 - DNA, 443 bp, Homo sapiens
  misc_feature (438)..(443): n is a, c, g, or t
tactaggatgaagctgggacttaccatgcacaccagtttgttctcctgggtctccttctcaaaggagacctctgccacctcatcgcctcctgcgatcctctccccaacatcaccactgagtcgcatcacctccacgtgcagccgacctgccacctgcagcaatgagggaaggcagaaacatttctccagatttggaaacaaggcatgaagagaaaaccaacctctcctttctggttgatgatgggaacagcgtattgtaacttcacatcatagaaaagtgactcgaggaagacattggccaccccaatgagactgtgattttcctgctcatcatagaatggatcagcacgtttgaagtatgatcgtattacctgtaaagagattgagaacacacaacttcagaaaaaccatttacaataaatgcattcaacctaaaannnnnn

SEQ ID NO: 283635 - DNA, 452 bp, Homo sapiens
ataaattggagtgtttctgcaaattctaagaggttcttaacattatccagaatggtgccctggtggacgatcatgcaccttgctggcgaggcgctttcttcaggtccataaatgcttgctgtgagtgaagaactgaagaactgtcctatttgcattctaaccacaaaaaagctagaggactcaggagttagagttgctttgatctacacatattcttgttgcttctatccctttctaatgctacagattgcactgatgcagtgaagcactgccaaatcaacgtggttaggaaagcagaagagcaaattaacagaagtctccttacagtatgaccacacaacaggagaaattgcaaaacattaactaaagttaaaaagtggtcgaactagcatgtgcacataaacatcttattatttaacaaaaaataaatttacccctaggaatacctactg

SEQ ID NO: 283636 - DNA, 4203 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgatttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttctacaaaacgacaggcttttctggggaaagagagatcccttgggtggacaattggccactgtgtccggtgtgcacacggtggaattccacggtggggcgttaacaggaaagggcagagaaagtatgaggaaacgaacggggaaaaaagcgatgaggggaaaaaaagagttgtttatcttgttatttaaatatataattgg

SEQ ID NO: 283637 - DNA, 5430 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgatttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagatttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttcttta

SEQ ID NO: 283638 - DNA, 4230 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgatttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtgtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttcttta

SEQ ID NO: 283639 - DNA, 683 bp, Homo sapiens
tttattgtgtgtaaggacttatggattattattttattcaacctgttatatcctaatattgtcattatttactcagttgctctgtagatacttaagaattttttaaaaattagttttatcaaccggatgttatcctttgacttcttacatgtttttgagtattgtgaacaattttctgatatgaaaataaaattcttactgtcagtattccttatatccatatacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggtatttttaaaagaattgtcatttattctaatattgaaatatgacagagcaaggctgaaaaatctagttgctgctgacagtttcatataattcagctttttgatgataggaaatctatttcttactcgtgtacttttaatagtttatgatgtgggaaaatgtacatttaaacaatattgtagatagaggagaaagttgattgtgaacaatgaaaagtagttgaatgaaatgactcataacattctttaaataaagtatctttgtattaaaaatattatggaatttgatcaaaacacaagaga

SEQ ID NO: 283640 - DNA, 384 bp, Homo sapiens
aaggaggcctcttatccaatgatcaaaatatatcttactttctctttttatagaaaagtttcttttgatgctacaatcagtaaagagggcatttgctattgattctagtcatccctggcttcatgagtgtatgattcgtctctttaatactggtatgtttttgttttccattacttaagtatttgatacagtggttgatggtgacggtataagtggtctgtacaagtttatcataaaccaaatgattttaaagctgtcacatactaaattagctaagggaaaagcagggcttttttctttatgatgaaggtttttattttaaggatacaagtattacctgattttgacatagaattattcagtccagatatttgagaatcatct

SEQ ID NO: 283641 - DNA, 6172 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgatttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagatttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgagatttcaaagaaagactgacctttcaaatagaaggcggtctttctattctagctaatgccccacttctttaagttataaacaaagtttcatgataccattctgctatcatctaaactttgctgaactctactgccaacctacattaaaaacaaagtcccacgaaatggctgtgttacaccatagtgagcagaaacttaaattttgttctaattttgatggttgaaaaatttcaacctgtagcaataaaacatttttgg

SEQ ID NO: 283642 - DNA, 6116 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgatttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcattgtaatacttgaagccctacatttctaagaatatatttcttgctcagttgtttcaggcaagcccaagactttgtaatttttaaagggcccaagatttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgagatttcaaagaaagactgacctttcaaatagaaggcggtctttctattctagctaatgccccacttctttaagttataaacaaagtttcatgataccattctgctatcatctaaactttgctgaactctactgccaacctacattaaaaacaaagtcccacgaaatggctgtgttacaccatagtgagcagaaacttaaattttgttctaattttgatggttgaaaaatttcaacctgtagcaataaaacatttttgg

SEQ ID NO: 283643 - DNA, 5525 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgcattttcctacatattttacaaatgtggaagaggttcaatgacttgcccaagaatatgcagcacttttgttgcagatctgtcagatggggagttgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgatttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagatttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttcttta

SEQ ID NO: 283644 - DNA, 355 bp, Homo sapiens
ctgggaaactataaactacctttgctacattgcttattctttattattaatcgggttacattttaatcataaaagatatcacaagagataggatttggcttccattttttaaaaattgccatcagggaaaaaatatgaatttttgtggtttttttttttttcatataatttccacctcttccacctcctgccaattgcaagtctgacactatcctttctttctgtctcgatggatctacttttgaacttcctagacttattttggattccttctgggtgaataagtattatgagttctataatattttaataacaataactagcattgcatacttacatttattatataagaccc

SEQ ID NO: 283645 - DNA, 445 bp, Homo sapiens
ggttttttttttttttttttaaacaaacaaacttttacagctctttgccggcccactgtttgaattctgtgaagcagaaaatggttaaattcttagcacagtcgacctacagcagagaagcaagttcagtgcccacggctggctcaggttttcgtgttttcaggacagaattttgtgcgttctttcggttcgcggtcctgattcattagcggtggggggtgggggaaacaacaaacaaaaacaaacaaacaaacaaacacgaccaacaacgaactacagagtctggcctgctcgggcatttccctcaaatccccctcctagtcataaaaagaagagagagagagtgagagagagagagagagagagagagggaaaaaaaatatttctcaaatggcaatagacctcactacaaattattcatgaagacagttctcgattcaacagg

SEQ ID NO: 283646 - DNA, 535 bp, Homo sapiens
atgtaagggcatgtggctccccggttctctggtctttttttccccttcctgtgtggggatactgatttctggtcacaggagtaatgcccactttcccacccttgcctccccatccccatgagcacagtcaggcctgaatgcaaagcctgatgttgccaccgctagtgctatgaccttgggaacattactcacatttcctgagcctcaaggccttggtctataacacgagcataataaaatgtgagcggttgttatgagatttaaataagattaaggaagtgttacggttgtgttcagcatgttgcctggcagatactaaagattcaacaaatggtagctaatcttgtcagtcctggcttttaaaaacatctttcccagccatttcttaggctgtctagtttcttatcataaatacacagccagttgagaattgagttacatcttaagaggaaatttgggacagtaagtaatcttgccaatagtgcctctctgctatcttaaatctgtgtctcttcctcaatgcccttatcctccc

SEQ ID NO: 283647 - DNA, 1010 bp, Homo sapiens
ttcttctgctggtgaggcattgttttcatggttctctttccaaagaggatagtccagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggactttgcaagtattttgattgctgatatttgatttcaggaacaaactgctcagtttagcagttttcccataggcgtcaaataaaacattctatatttcattaagtactaaaggatcagacaagtatataaagtaagtcagttccttctgccttctcaaatctcagtgttgacatgggaaaatattaaggagaactaaggatttagccccttcttgggtcacttttttctgcctctgacacattatgagacctgtctaatccctttaggagacagtgtggagcccgagttcataacagccccattgttgatgcaactccttcactccatgtaagcggtaagttccagaaggcttcctcctatcatgtaaaaatatatttctgttgaaacttcaagagttttattttcaaagtgttggcatggcctataagaggcctgtcaagttttagtttaaaagtagaatgtattcttaccagtaggagggaacactgtatgctattatagttagtagcaatgttactgcagccaaa

SEQ ID NO: 283648 - DNA, 3581 bp, Homo sapiens
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagcca

SEQ ID NO: 283649 - DNA, 2367 bp, Homo sapiens
  misc_feature (358)..(358): n is a, c, g, or t
tattcctgatcaggttggcgcagcaacaaataaacaggtgttatttcaaaaccaattaccagagaccaaatccagttactagagcccaagcaaatgagaacaggtaagattccagtctccccctcttacaggcatctctgactatgagtgattctcttggagcccaaccatgacaagagacagaactccccaccacaaagactgcactgcatatctcataaaggagagcacactatggacagcctcctcctctccttcccagccccctccttatgtgggctgcagatgagcattgatagtagtaggactggctctgctacatcatcatagactctgaagggaggtgtgtgatattgantgctgaaaggtccctagaggctctcttcatactattcaacattctgttacagtcattaaaaaataatgtgtacagagatgtcctgatacacatgtccttcattttctgacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagcca

SEQ ID NO: 283650 - DNA, 2529 bp, Homo sapiens
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagcca

SEQ ID NO: 283651 - DNA, 4238 bp, Homo sapiens
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggactttgcaagtattttgattgctgatatttgatttcaggaacaaactgctcagtttagcagttttcccataggcgtcaaataaaacattctatatttcattaagtactaaaggatcagacaagtatataaagtaagtcagttccttctgccttctcaaatctcagtgttgacatgggaaaatattaaggagaactaaggatttagccccttcttgggtcacttttttctgcctctgacacattatgagacctgtctaatccctttaggagacagtgtggagcccgagttcataacagccccattgttgatgcaactccttcactccatgtaagcggtaagttccagaaggcttcctcctatcatgtaaaaatatatttctgttgaaacttcaagagttttattttcaaagtgttggcatggcctataagaggcctgtcaagttttagtttaaaagtagaatgtattcttaccagtaggagggaacactgtatgctattatagttagtagcaatgttactgcagccaaa

SEQ ID NO: 283652 - DNA, 3238 bp, Homo sapiens
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagtaagtgctatttggagaatattcttttttttccttcaaatggattatgttgttcctaatatcacagattgtgggcccacactaccttgagggaatccccaggaaaaaaaaaaatccaaagggatgcatggaaagccaacttcatgtgtctaatgagacatgtcatgttagatacataccccttgctcttcttttggaaaatactctaagagagaaaggtta

SEQ ID NO: 283653 - DNA, 2195 bp, Homo sapiens
  misc_feature (25)..(26): n is a, c, g, or t
tgcgcgctgctcttccccgcggagnncgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttc

SEQ ID NO: 283654 - DNA, 768 bp, Homo sapiens
cataaaattgatgaaaaggaagaagtttgatgaatcccattgtgcctggccacattctttaaattttgaaaccttttattttagtgtgtctaataatacttgcttccatgagttctcaggtttgttttgatctcacagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatgaacatggcaggttgcctttctaagggattcttgggcctttgtatttccatataaatttagaagcagtctgacaacctccccaccaaaaaacctaaaaaacaaaaatcttctagactttggaacagcactgaattaatgatcagtttgggaaacgttaacattacaagtttaataaaccatgaacataatatacccctccaatatctagattattttatatacatagtagcccacattttctaagcatttattacatgccaggcaccattaggactttacataaatgatttcatttaatcttcacaataatgctgagaaggaggctctagtacttccatttcacggatggagaaacgagtttagcaaggtggccaaaggtcacggttaaccagagatgagaatcaggcactctacctgcagtctgcagtctgtaccactttttgacatgaccttcctgagct

SEQ ID NO: 283655 - DNA, 408 bp, Homo sapiens
tttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaatttt

SEQ ID NO: 283656 - DNA, 452 bp, Homo sapiens
tttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacatgaagagatgggaatccagggctcagggttcaacgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctc

SEQ ID NO: 283657 - DNA, 224 bp, Homo sapiens
tttttggtatgattctactttatgaattgttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagatgcgtgttataagatcctctagagtaccttg

SEQ ID NO: 283658 - DNA, 2384 bp, Homo sapiens
  misc_feature (25)..(26): n is a, c, g, or t
tgcgcgctgctcttccccgcggagnncgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttc

SEQ ID NO: 283659 - DNA, 2515 bp, Homo sapiens
  misc_feature (25)..(26): n is a, c, g, or t
tgcgcgctgctcttccccgcggagnncgcgcagtccgcgcagccctcatcgcaactgggcccgcgcgcagttccacagctccagctacaaaagaactgaaaaggaacagggaaggtgcatggcgtcttggattccaggaagtaggcagtgtgtatggttactggaatttacctgccatcttgctcaattatcctgtcaaagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttc

SEQ ID NO: 283660 - DNA, 2432 bp, Homo sapiens
  misc_feature (25)..(26): n is a, c, g, or t
tgcgcgctgctcttccccgcggagnncgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttcacaaaataaaaaaaaaaactttagggggggcccggaccaaattcccct

SEQ ID NO: 283661 - DNA, 429 bp, Homo sapiens
actgctgtcacatattgtcatacgtggggggctgttactgggttctccagtctcctccctttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttccacattggtcagctcctctttttattagaattattccc

SEQ ID NO: 283662 - DNA, 891 bp, Homo sapiens
cataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattgttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagattaacacgtgtttgaatatgtgacagttccacagctccagctacaaaagaactgaaaaggaacagggaaggtgcatggcgtcttggattccaggaagtaggcagtgtgtatggttactggaatttacctgccatcttgctcaattatcc

SEQ ID NO: 283663 - DNA, 1287 bp, Homo sapiens
  misc_feature (25)..(26): n is a, c, g, or t
tgcgcgctgctcttccccgcggagnncgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggtcaagttactcac

SEQ ID NO: 283664 - DNA, 2168 bp, Homo sapiens
  misc_feature (25)..(26): n is a, c, g, or t
tgcgcgctgctcttccccgcggagnncgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcaccccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctccctttatctgtttgtgtatccctgtgctggtgccacactgcctcgttcactgatgtttttaataagcctgcaccttactacacaatcaagacgcctcggttattctcttcctctctct

SEQ ID NO: 283665 - DNA, 1082 bp, Homo sapiens
  misc_feature (1082)..(1082): n is a, c, g, or t
tgcgggcctgcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtcttggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaagttatggaggctagaattctgacagcagggtgtgcagagggccatgctctttcctaagactctaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaaggtaattttcaccttttgcaatggttcctacagtttgtaatttctaacaacaaaaataaaatgctttttttaagn

SEQ ID NO: 283666 - DNA, 2311 bp, Homo sapiens
tgcgggcctgcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtcttggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtattccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggtaactcacgtggtctttgcatctcatttctatcagagggatgtcgctcccctacagggggcagtagtgaaaaaagagtcattctctggcccaggtgaactccccgacactgttagaacaatggcattactcttcagttctcaccatttttacccttctgcaaagtctcttgtaattcctaagtaatgaaatgaaaagtacaaatttcttaaaacaagc

SEQ ID NO: 283667 - DNA, 2964 bp, Homo sapiens
agcgagagctggtcagcgagggcatggtgggtcagacaccgtcatgcccctggtgcgcggcgtccgtagcccgcgtgcgatgacgggattcgtgcacgcacggcctcgaccggggtctaagagcggaaagccgagattcctggagcgcggcgccggcccgagaatgtgccggcgtggtcgaacatggtgcggcgatgtcccgcgaatgcggcgcagagtgcgcggctgagtgtcccggggggggcagctgccagtcgtggatcaggcgctcgaggagcgccccagtgacccgggcgtgctcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagtgtgattatattaatgttccgactacagtgtttactcctctggagtatggttgctgtggattatctgaagagaaagctattgaagtatataaaaaagagaatctagaaatatatcatactttgttctggcctcttgaatggacagtagctggcagagagaacaacacttgttacgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctaaaaagtagtggttttctagtgcgtgggcctagaattcacacatgctcactggtgaacagtgtctgtgggctgctgtgggctgcatttggatagctgtctgcattagcaggaagctgtacacactgtgtagggttagtcatctcttttcttttttgaggcacatttaacctactgtcaaaacgctgactcatgcttcaccctcacactcactacttggtggtgataaccttgaagctattctcccctaattaatatctcgagactgagcaaaatatctcatgtaagataaaagtacttgaattgctttttcatgttcatcttaatagtattatttccaaaagtttttaatactgtattatgtgaaatctaactaatttatctgtgaaataattccatcacagtctgtttaatgatgataaagttccataaatgaatacaggt

SEQ ID NO: 283668 - DNA, 2678 bp, Homo sapiens
tgcgggcctgcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtcttggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagtgtgattatattaatgttccgactacagtgtttactcctctggagtatggttgctgtggattatctgaagagaaagctattgaagtatataaaaaagagaatctagaaatatatcatactttgttctggcctcttgaatggacagtagctggcagagagaacaacacttgttacgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgcta

SEQ ID NO: 283669 - DNA, 1531 bp, Homo sapiens
  misc_feature (25)..(25): n is a, c, g, or t
  misc_feature (31)..(31): n is a, c, g, or t
  misc_feature (41)..(41): n is a, c, g, or t
  misc_feature (43)..(43): n is a, c, g, or t
  misc_feature (54)..(55): n is a, c, g, or t
  misc_feature (60)..(60): n is a, c, g, or t
tagctttttccatgatgtaaaaccnggcaancttgacggtntntaattggaaannccctnccgattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtattccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggtaactcacgtggtctttgcatctcatttctatcagagggatgtcgctcccctacagggggcagtagtgaaaaaagagtcattctctggcccaggtgaactccccgacactgttagaacaatggcattactcttcagttctcaccatttttacccttctgcaaagtctcttgtaattcctaagtaatgaaatgaaaagtacaaatttcttaaaacaagc

SEQ ID NO: 283670 - DNA, 167 bp, Homo sapiens
ggagcagcatggtgtgaagttcctacggaaattcatacctgtgatggtaaggctgcatggcatttgcaattttttttctctaacttttcactttatctcaccttacttcatttcattacataaattagtctgtattcaaataatgttaaaacagtgtttccactccc

SEQ ID NO: 283671 - DNA, 339 bp, Homo sapiens
atgatgcatttgctaattgccctgatctgatcactatacatcatatgtatcagaacatcactgtgaaccccatgagtatgtacaattatttgtccattaaaaaaaataaaatagaaagtatgggtggtataaaatatttgatgtcgtgcatatttttaaatcttcacaaaaaaatcattatagaggaagtaaaatatgtgagaataatttatcattcttttcactttttttaaaggtgatggatgtggacacactgtactaggccctgagagtggaacccttacatccataaactacccacagacctatcccaacagcactgtttgtgaatgggagatc

SEQ ID NO: 283672 - DNA, 2912 bp, Homo sapiens
cgcgcgggtggtgagagtggccagcgagggcagcgttcgccgcccctcaggccccgtcccggcgccgcagccgcctgcgtttcggtttgtgagcaggcccggccgggccaggagcgagagcgagactctggagcggtcgccgccgcagtcgcccgggccgggaaaggcgggcgatgcccccaaccgccgctcgggccatgtccgaggggcgcgcgtgttgtcgccgccggggcgccgtgcccgcctgtcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagtgtgattatattaatgttccgactacagtgtttactcctctggagtatggttgctgtggattatctgaagagaaagctattgaagtatataaaaaagagaatctagaaatatatcatactttgttctggcctcttgaatggacagtagctggcagagagaacaacacttgttacgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctaaaaagtagtggttttctagtgcgtgggcctagaattcacacatgctcactggtgaacagtgtctgtgggctgctgtgggctgcatttggatagctgtctgcattagcaggaagctgtacacactgtgtagggttagtcatctcttttcttttttgaggcacatttaacctactgtcaaaacgctgactcatgcttcaccctcacactcactacttggtggtgataaccttgaagctattctcccctaattaatatctcgagactgagcaaaatatctcatgtaagataaaagtacttgaattgctttttcatgttcatcttaatagtattatttccaaaagtttttaatactgtattatgtgaaatctaactaatttatctgtgaaataattccatcacagtctgtttaatgatgataaagttccataaatgaatacaggt

SEQ ID NO: 283673 - DNA, 2471 bp, Homo sapiens
cgcgcgggtggtgagagtggccagcgagggcagcgttcgccgcccctcaggccccgtcccggcgccgcagccgcctgcgtttcggtttgtgagcaggcccggccgggccaggagcgagagcgagactctggagcggtcgccgccgcagtcgcccgggccgggaaaggcgggcgatgcccccaaccgccgctcgggccatgtccgaggggcgcgcgtgttgtcgccgccggggcgccgtgcccgcctgtcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagtgtgattatattaatgttccgactacagtgtttactcctctggagtatggttgctgtggattatctgaagagaaagctattgaagtatataaaaaagagaatctagaaatatatcatactttgttctggcctcttgaatggacagtagctggcagagagaacaacacttgttacgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgcta

SEQ ID NO: 283674 - DNA, 2298 bp, Homo sapiens
tgcgggcctgcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtcttggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtattccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaa

SEQ ID NO: 283675 - DNA, 1912 bp, Homo sapiens
tgcgggcctgcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtcttggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtattccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattcctaaacaagtcgtaaaactggaagctttgcaagaactcaatgttgctttcaattctttaactgaccttcctggatgtgacagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatc

SEQ ID NO: 283676 - DNA, 4520 bp, Homo sapiens
tgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctcccc

SEQ ID NO: 283677 - DNA, 5163 bp, Homo sapiens
gcgcgctggactcggtcaccgcgggctgcggcggctgggcggggctttcgggcgcccgcgggacggttccgccctctcactgcacccccgggcttctcttcgcaaggttcacctcgaatgaggaacaagcggggagggaagggaagggctgcggcggcgcgggcgcaccccgtcgggcccggggctgggggaggccaggtcacgtaactgctgctctggcgtcgggccggggagggggcgccagccccggcagcgcgaaccctgcgcgcgccgcggctctgaaacagttaccggctagtaaacaacagctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagttcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctcccc

SEQ ID NO: 283678 - DNA, 4383 bp, Homo sapiens
gcgcgctggactcggtcaccgcgggctgcggcggctgggcggggctttcgggcgcccgcgggacggttccgccctctcactgcacccccgggcttctcttcgcaaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctcccc

SEQ ID NO: 283679 - DNA, 2487 bp, Homo sapiens
atctcagctctactatttcctagctttgtaaccttcagcaaagcacataaccatgtaaaatttaattttattcatttgtaaaatgggactaataaatctaaagtgcttatcgtagtgcctgatacatagtaaagctcagctctcaatgaactgttgctgctgctgctgttgtaggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctcccc

SEQ ID NO: 283680 - DNA, 3296 bp, Homo sapiens
gcgcgctggactcggtcaccgcgggctgcggcggctgggcggggctttcgggcgcccgcgggacggttccgccctctcactgcacccccgggcttctcttcgcaaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatggtgagaaagctgagtttgagatacaagaggttcattcccccattcctctccctgtcttccttgaatcttttctggtttgggaaatttttcagatctaaatgtggattaatcccctagtgccaaaaaaaaaacaaaaaaaaaccctaatttgttgccctaagtagaatgtatatgtgatgcatgtttgatgttattttttggttttgctttcttgtttattacacagcccttatatttctgccagattctcatctgcttaatatagttttatgaaatttttattcatatattcagcttaaaatcacacatggcttttaaaaaaaacctaacagtat

SEQ ID NO: 283681 - DNA, 465 bp, Homo sapiens
aatggtttttgatacgtaatgagaaataacctactaagtaaataggaccccttgctcaaagaagtgtgaaaagagcatttccttgctttcctgacatgctaggaagcaaggcaagcctaaggattcttctctgcttattcttttttctccctaggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtattttatacaactttttttttacaaaagtctttctcccttctgtcctggttcacaggacagacaaattcttcctctgattataatagtgttggggtttagaatcagaagagttggaagttattctaggctttcccatga

SEQ ID NO: 283682 - DNA, 4254 bp, Homo sapiens
ctggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatgaaccagacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctcccc

SEQ ID NO: 283683 - DNA, 3898 bp, Homo sapiens
ctggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatgaaccagacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaccattgcactccagcctgggcaacaagaggaaattctgtctcaaaaaaaaaagaaaa

SEQ ID NO: 283684 - DNA, 5012 bp, Homo sapiens
gcgcgctggactcggtcaccgcgggctgcggcggctgggcggggctttcgggcgcccgcgggacggttccgccctctcactgcacccccgggcttctcttcgcaaggttcacctcgaatgaggaacaagcggggagggaagggaagggctgcggcggcgcgggcgcaccccgtcgggcccggggctgggggaggccaggtcacgtaactgctgctctggcgtcgggccggggagggggcgccagccccggcagcgcgaaccctgcgcgcgccgcggctctgaaacagttaccggctagtaaacaacagctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctcccc

SEQ ID NO: 283685 - DNA, 413 bp, Homo sapiens
tttccttacttgatctttctccctatttcttttcacttagggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacaggtaagttagggagttattggacaagttttttcctattttttggggaaaataggccttgtcatcttagattcctctactgtccataaagattcactgccatggtgctaattcccttcttaagcacaccacacagctcttaattcaccatatttctgctt

SEQ ID NO: 283686 - DNA, 544 bp, Homo sapiens
aaggctgcggccgcggcgtcggcggctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgctggacaccatccggcccgagcacgtcctgcgcctcagccgggtcaccgagaattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgact

SEQ ID NO: 283687 - DNA, 358 bp, Homo sapiens
gggcgccgctgacacgttggctctgctcctgctcatgcgcggcctggggcgcccttctctgacgcgattctaacgcgaccccggaagcgcgcagcgagcagaggaccctgcattcagatgcagcagatgacaccacccaaacggataatctggctcaaccatgtgtgtgatcccacccagggacagaagtcagccagaactcattttgaccccctatgatttaatcttcgacctgaccaatcagcactcaccactttctgagcccatacccgccaaattatccttaaaaacacggatccccgaatgcttggggagactgatttgagtgataataaaactctgctctcctgcacagcca

SEQ ID NO: 283688 - DNA, 323 bp, Homo sapiens
ccccaaattgcttctgggaataacatcactgttgcaaaacttaaggtcagtgcttgaaatattttgtagaccctgcattcagatgcagcagatgacaccacccaaacggataatctggctcaaccatgtgtgtgatcccacccagggacagaagtcagccagaactcattttgaccccctatgatttaatcttcgacctgaccaatcagcactcaccactttctgagcccatacccgccaaattatccttaaaaacacggatccccgaatgcttggggagactgatttgagtgataataaaactctgctctcctgcacagcca

SEQ ID NO: 283689 - DNA, 309 bp, Homo sapiens
  misc_feature (41)..(41): n is a, c, g, or t
gtgcggaagacgaggacgtcggcaccgctggacaggagganaacaaaaacttaggaccctgcattcagatgcagcagatgacaccacccaaacggataatctggctcaaccatgtgtgtgatcccacccagggacagaagtcagccagaactcattttgaccccctatgatttaatcttcgacctgaccaatcagcactcaccactttctgagcccatacccgccaaattatccttaaaaacacggatccccgaatgcttggggagactgatttgagtgataataaaactctgctctcctgcacagcca

SEQ ID NO: 283690 - DNA, 951 bp, Homo sapiens
gcggccgcgccaactccggcgtcgggaacactcaccgcaggacgctttgccctccttggaatcgcagtagccgcagtggtagccggccctgaggcccttgtattccaccaccgacgccatggccgccgcgagggtccgctcgggccgaccacgcctcttggcgcccggggccgacctcggcgaagcgctggggcccgcggcgggaggggtggagagcgaagcctggcgcggggacccgtgggcggggatggtggtcgtgtccccaagccctgcgtttgggccggtgcttcccacagctgtgcgttatcagccccatttcacagtttgctaaagcagaggcgtactactatcaatagcatcaagaaatgatgatggaagaagcatggaaatacaatatggttccaaaatgggaaactaaaatagaggaagaggaaaagagatcacaacgtgagaaaacagaagatactaaaaaatgggactatctagtgcctgagagggaactgagtcttacaaagaaacatataccaggctgaacaaaccagaggcctcagagaccacaaacaccgactgctccctcaaagaattcccagtgaaatactttcccctaaaatactaacacgggaaaaggatggaaagcatgaaaatatccagaaaacacacaaaactgaaaccagtaagcacaaggtggcatggacaaaggaacagatgaagggacaccaagaccgaatgatctgagggagagaactcaaagcaaagacacgctcagaagcgctccagccccgttccatctttcctaaaatctcaagtggaaaaagagaaggtgaaagagtttgaatgggtcacagcttatccaattttgcaaccttaccagaaagcacttaggaaagtgatgattctgatggagaaataagaaaaaagagagtataaaattaagaaaccactctgaaggga

SEQ ID NO: 283691 - DNA, 497 bp, Homo sapiens
actggagcacagcggtgtttcccaacaacatccccctcccccggggccatcttcagtgagccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaa

SEQ ID NO: 283692 - DNA, 1395 bp, Homo sapiens
ggtacccgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttggtagagatgggggtctcgctatgttggccaggctggtctcgaattcctggcctcaacgatcgtcctgtctcggcctcccaaagtgccgggatgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaa

SEQ ID NO: 283693 - DNA, 1317 bp, Homo sapiens
  misc_feature (28)..(30): n is a, c, g, or t
aactacggctaggtacgaggctgggtgnnnccagcactttgggaggccgaggaaggcagatcacctgaggtcaggagttcaagaccagcctgaccgacatggtgaaaccccatctctactaaaaatttaaaaagttagccgggcctggtggcgcacgcctgtaatcccagctacacaggaggctgaggcaggagaattgcttgaaccagggaggcggaggctgcagtgagccgagatcgcgccactgcactccagcctgggtgacacagcaagactccgtctcaaacaaaacaaaacaaaaaaccttccagcttggagaaactgagagtgagcagtagggagtgagggggtccctgggaggaaccagaactcatcccgcttcagggtggggctggcccccttcttggccttggccggggcttcgtgtcacggagcgcccgagggacggtcggagcccaccccagcccgcccgccgcctgagcctggccgagctctctgcacctgcacacgtctgtaaaacgcggatgaaacgcttctacggaaccgggtggctgagatgaactgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaa

SEQ ID NO: 283694 - DNA, 714 bp, Homo sapiens
ggtacggccttcagcagtcacatcctgggtggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaa

SEQ ID NO: 283695 - DNA, 1564 bp, Homo sapiens
ggtacccgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttggtagagatgggggtctcgctatgttggccaggctggtctcgaattcctggcctcaacgatcgtcctgtctcggcctcccaaagtgccgggatgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaaaaaaaaaaaaaaaaaaaaaggggggcgccaaagattccggggggccatccgccccctttgcaaggggccaaagagggtaaaaaaagggcgttaaaagaggaacggcctgcctggggacccccggtgatggacccaaaccggaaaattaggaccatcgggagttgtacat

SEQ ID NO: 283696 - DNA, 610 bp, Homo sapiens
ggtacccgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttttggggtgagaaaggggggttccgcatggtgggccagggggggctcgagaactcccggtggcgctacaagaagactggggccggggctcggagccctccacaaaggtggccggggagagcagggatgagacgccacacggggctggggccccttattattgtggaaggggcgccccttgggatacccggtctaaagtgcccggggaaaattacggg

SEQ ID NO: 283697 - DNA, 910 bp, Homo sapiens
ggtacccgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaa

SEQ ID NO: 283698 - DNA, 1611 bp, Homo sapiens
  misc_feature (1527)..(1528): n is a, c, g, or t
ggtacccgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttggtagagatgggggtctcgctatgttggccaggctggtctcgaattcctggcctcaacgatcgtcctgtctcggcctcccaaagtgccgggatgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaaaaaaaaaaccggggcccttttcgggcggggaaaggggttgatggcatggttccgttctgccgtttttgcagggggaatgccgcccttggggcgtatcagaccagtggttgtcacgagaccaagacccagaanntaaaacacaaagcgagcaaaaagcaaacacaaaccacaaaaaacagacaacaagcaacacaacagaacaaagcacatatcagc

SEQ ID NO: 283699 - DNA, 2629 bp, Homo sapiens
  misc_feature (2533)..(2533): n is a, c, g, or t
ccaaagctcccaccaaagttcaacacgcccccaaagccagcgcctgattggcccgccctgcccacaagctgaggcagcctcaccttctgattggctgttatgctccctgttcggtgctggaaccctccccttctctgattggccagatgcctacctgcgctcgccccagattgggcgccagctggggcggctcgttggctcccaggggccccgctctctgattcgccgctcgggccagcccccacggcctgcacgctgaatggctgcgccgctacctatattggcctccgattgggtgcacggcgcctccccggcgtgataggtcaggaccaccgcccccctggctccccattggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcagggtctacctgctgtaccacacctggagccaggtgctctatggaggcatcgctggaggcctcatggccatcgcctggttcatcttcacccaggaggtcctcaccccgctgttccccaggatagcagcctggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctgaanacaacaacaccaacacatcacccaccacaactacccacttcacacccacacactcacctccaccatccactcctacacgcacacaaccatcgccaa

SEQ ID NO: 283700 - DNA, 2402 bp, Homo sapiens
ccaaagctcccaccaaagttcaacacgcccccaaagccagcgcctgattggcccgccctgcccacaagctgaggcagcctcaccttctgattggctgttatgctccctgttcggtgctggaaccctccccttctctgattggccagatgcctacctgcgctcgccccagattgggcgccagctggggcggctcgttggctcccaggggccccgctctctgattcgccgctcgggccagcccccacggcctgcacgctgaatggctgcgccgctacctatattggcctccgattgggtgcacggcgcctccccggcgtgataggtcaggaccaccgcccccctggctccccattggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcaggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctga

SEQ ID NO: 283701 - DNA, 2477 bp, Homo sapiens
ccaaagctcccaccaaagttcaacacgcccccaaagccagcgcctgattggcccgccctgcccacaagctgaggcagcctcaccttctgattggctgttatgctccctgttcggtgctggaaccctccccttctctgattggccagatgcctacctgcgctcgccccagattgggcgccagctggggcggctcgttggctcccaggggccccgctctctgattcgccgctcgggccagcccccacggcctgcacgctgaatggctgcgccgctacctatattggcctccgattgggtgcacggcgcctccccggcgtgataggtcaggaccaccgcccccctggctccccattggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcagggtctacctgctgtaccacacctggagccaggtgctctatggaggcatcgctggaggcctcatggccatcgcctggttcatcttcacccaggaggtcctcaccccgctgttccccaggatagcagcctggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaactcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctga

SEQ ID NO: 283702 - DNA, 1884 bp, Homo sapiens
ccaaagctcccaccaaagttcaacacgcccccaaagccagcgcctgattggcccgccctgcccacaagctgaggcagcctcaccttctgattggctgttatgctccctgttcggtgctggaaccctccccttctctgattggccagatgcctacctgcgctcgccccagattgggcgccagctggggcggctcgttggctcccaggggccccgctctctgattcgccgctcgggccagcccccacggcctgcacgctgaatggctgcgccgctacctatattggcctccgattgggtgcacggcgcctccccggcgtgataggtcaggaccaccgcccccctggctccccattggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagcccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctga

SEQ ID NO: 283703 - DNA, 2531 bp, Homo sapiens
ccaaagctcccaccaaagttcaacacgcccccaaagccagcgcctgattggcccgccctgcccacaagctgaggcagcctcaccttctgattggctgttatgctccctgttcggtgctggaaccctccccttctctgattggccagatgcctacctgcgctcgccccagattgggcgccagctggggcggctcgttggctcccaggggccccgctctctgattcgccgctcgggccagcccccacggcctgcacgctgaatggctgcgccgctacctatattggcctccgattgggtgcacggcgcctccccggcgtgataggtcaggaccaccgcccccctggctccccattggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcagggtctacctgctgtaccacacctggagccaggtgctctatggaggcatcgctggaggcctcatggccatcgcctggttcatcttcacccaggaggtcctcaccccgctgttccccaggatagcagcctggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctga

SEQ ID NO: 283704 - DNA, 2490 bp, Homo sapiens
  misc_feature (2470)..(2470): n is a, c, g, or t
ccaaagctcccaccaaagttcaacacgcccccaaagccagcgcctgattggcccgccctgcccacaagctgaggcagcctcaccttctgattggctgttatgctccctgttcggtgctggaaccctccccttctctgattggccagatgcctacctgcgctcgccccagattgggcgccagctggggcggctcgttggctcccaggggccccgctctctgattcgccgctcgggccagcccccacggcctgcacgctgaatggctgcgccgctacctatattggcctccgattgggtgcacggcgcctccccggcgtgataggtcaggaccaccgcccccctggctccccattggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcagggtctacctgctgtaccacacctggagccaggtgctctatggaggcatcgctggaggcctcatggccatcgcctggttcatcttcacccaggaggtcctcaccccgctgttccccaggatagcagcctggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtctgaagcagtcnggaggtaccgagctctatcc

SEQ ID NO: 283705 - DNA, 1734 bp, Homo sapiens
catcctggtccctacccctgctccaatcccctggctccacttctgggattgcagactgagataactgaggtacaggcctcgcggggagatcagccctgtctaggtgccattcccagggcaggtgctctgattggcccagttcaggtcaatcgctggctactgggtgtgggcatttgcctacttagttgggactacgggtggggtggggacagctgtaggtcactgaacaccagatgtctccacatctgacccccatcctgttttgcaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctga

SEQ ID NO: 283706 - DNA, 540 bp, Homo sapiens
gtggggaataccattagctgttgatagcgggccatgtatccgaggaaagcctgagctacaaggcaaaggcatcccatctggaacaaaatcagaaagctattggcaaaggtaatcaatcaggccataaatagccatttacccgcttccttttcggggctggaggtgggccgggagccctccaagggtgagctgggcaacttgtagagcaaggaatatgccctccgctgccggcgccccggccgcttttgtctgggctcccagccgggcttccgaggctttgtaccatggatttgggagtgacaatgggcatttccctcagattcaaggctgctcaacctcacctctgtagggggaaaaaaatcagaagggagtgtcccaaggacctagccattcggccgaattttttagacattttgggagtctcctccgaggcctttaagtgcgaaccgcgcgaagcggccctgcccggggagactcgctgaggcagggctgaggcggcgggcgggagcaagctgctctagcatttgggttctgccctgt

SEQ ID NO: 283707 - DNA, 3149 bp, Homo sapiens
gtggggaataccattagctgttgatagcgggccatgtatccgaggaaagcctgagctacaaggcaaaggcatcccatctggaacaaaatcagaaagctattggcaaaggtaatcaatcaggccataaatagccatttacccgcttccttttcggggctggaggtgggccgggagccctccaagggtgagctgggcaacttgtagagcaaggaatatgccctccgctgccggcgccccggccgcttttgtctgggctcccagccgggcttccgaggctttgtaccatggatttgggagtgacaatgggcatttccctcagattcaaggctgctcaacctcacctctgtagggggaaaaaaatcagaagggagtgtcccaaggacccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggacgcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcaggcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgaagcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttttttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggaca

SEQ ID NO: 283708 - DNA, 2821 bp, Homo sapiens
ctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggacgcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcaggcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgaagcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttttttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggaca

SEQ ID NO: 283709 - DNA, 1451 bp, Homo sapiens
ctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggacgcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctccgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggaca

SEQ ID NO: 283710 - DNA, 2921 bp, Homo sapiens
ctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggacgcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcaggcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgaagcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttttttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggaca

SEQ ID NO: 283711 - DNA, 2896 bp, Homo sapiens
ctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggacgcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcaggcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgaagcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttttttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggaca

SEQ ID NO: 283712 - DNA, 3636 bp, Homo sapiens
accggctgactcggggcgccggtagcgtcgcttcctgctagtgaacgcccggggcgtaccggagcctctgattacaccgaccatcctcccaccctctccaactacacctctgggaccgcgactgcgcagggaggagccggccgaaccatggaccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtggccaacaggctcagtttacaaacctgtgagctactgttggctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggcaaa

SEQ ID NO: 283713 - DNA, 3572 bp, Homo sapiens
accggctgactcggggcgccggtagcgtcgcttcctgctagtgaacgcccggggcgtaccggagcctctgattacaccgaccatcctcccaccctctccaactacacctctgggaccgcgactgcgcagggaggagccggccgaaccatggaccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtggagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggcaaa

SEQ ID NO: 283714 - DNA, 3559 bp, Homo sapiens
accggctgactcggggcgccggtagcgtcgcttcctgctagtgaacgcccggggcgtaccggagcctctgattacaccgaccatcctcccaccctctccaactacacctctgggaccgcgactgcgcagggaggagccggccgaaccatggaccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtggccaacaggctcagtttacaaacctgtgagctactgttggctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggggccagctggaggggtaccgagctc

SEQ ID NO: 283715 - DNA, 1043 bp, Homo sapiens
  misc_feature (19)..(19): n is a, c, g, or t
  misc_feature (32)..(33): n is a, c, g, or t
cagtatctcgggtatggtncgaggctgggtgnngctgctgctactgagtctccagcagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtggccaacaggctcagtttacaaacctgtgagctactgttggctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggcaaa

SEQ ID NO: 283716 - DNA, 2010 bp, Homo sapiens
  misc_feature (1950)..(1950): n is a, c, g, or t
  misc_feature (2003)..(2003): n is a, c, g, or t
accggctgactcggggcgccggtagcgtcgcttcctgctagtgaacgcccggggcgtaccggagcctctgattacaccgaccatcctcccaccctctccaactacacctctgggaccgcgactgcgcagggaggagccggccgaaccatggaccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactggggagaganactccctgagcctgtacccacagagactgtctcctagccagagactgaggctngtttgtg

SEQ ID NO: 283717 - DNA, 527 bp, Homo sapiens
tcggtaccccatgccctcatccagtggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccactggatgagggcatgcatgccctcatccagtggggagctgccctcagatccagcctggtgccctctgacctgggctctcctccggcccctcatgcctcctcctcaccaccttcagaccctcctctcttccactggatgaggtcatggggatccttctagatcacctcagcatcagctgc

SEQ ID NO: 283718 - DNA, 3135 bp, Homo sapiens
gcgaattcactagtgattgagctgaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtggccaacaggctcagtttacaaacctgtgagctactgttggctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggcaaa

SEQ ID NO: 283719 - DNA, 4178 bp, Homo sapiens
accggctgactcggggcgccggtagcgtcgcttcctgctagtgaacgcccggggcgtaccggagcctctgattacaccgaccatcctcccaccctctccaactacacctctgggaccgcgactgcgcagggaggagccggccgaaccatggaccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccccccccacacgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggcaaa

SEQ ID NO: 283720 - DNA, 3468 bp, Homo sapiens
accggctgactcggggcgccggtagcgtcgcttcctgctagtgaacgcccggggcgtaccggagcctctgattacaccgaccatcctcccaccctctccaactacacctctgggaccgcgactgcgcagggaggagccggccgaaccatggaccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccagctggactaggagtgggaagggcctggacactcacagaggccccctctgtcatcactccttgggacccaccaacttcctgcacacactggcagagaggggcgctgggaaatcaccccacaggcgggaggtctcctgttggctacactctaaagctgcttggccttcatgttcaaacagattcaggcaccaccccctcttccccag

SEQ ID NO: 283721 - DNA, 1724 bp, Homo sapiens
agacccctgactataatttctcaacaggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccccccccacacgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggcaaa

SEQ ID NO: 283722 - DNA, 448 bp, Homo sapiens
gggcaatctgtactttttatatcatcttcctgggtagagaacaacaggagccagacactctgggaaacttcctagtggcctagcattatgggaatgtgcccatactcctggttgaagtcttctactccgaatggagggaggccttgcccttcatatgcctaagaattgggctagactttcttggtcccagggagctgaggttctgaccctctggtccctagggactgggcttggaaaggatggttgtagactaagccagcagatccccgagatctttataggtgcttgcctcacattgttaaggatctttcttttgagagggtgctgggctgtgctgctctttagagttgggcagactcctgacagtcccatctctctacttgcgttgcaggtgtgggctaagctggtggccccggctttagactggaccccacaatgtttgcagaga

SEQ ID NO: 283723 - DNA, 1725 bp, Homo sapiens
gaccttgactttccagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgtgtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgaggaaaaaaaaaatg

SEQ ID NO: 283724 - DNA, 1807 bp, Homo sapiens
gaccttgactttccagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgtgtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataaggtgagtataactgagggggaaggacttaatttttcaagcatgaagtacacaactgaaactcaaatttttattccttccacagaaaacactagagaaacttcgagccaaaaatacatgctgactttctagaaatagtgtaaaggttttttaattgtgtatatgtagcattagacaaaattatttaaagtcaataaattgttattcgaggaaaaaaaaaatg

SEQ ID NO: 283725 - DNA, 396 bp, Homo sapiens
gatgattaactgatttttgaatttcttaatgcaggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaaga

SEQ ID NO: 283726 - DNA, 449 bp, Homo sapiens
ctttcagtccattgtcacactatttcatcccctccccaaagtaggctccagtatttctacaactgaatgctggagttatggaagcctaaggaaatctgatctgttggtctttgccaatcattgcttttcttcctccattttcacatttatatacacttgcaaaaaatgtgcattatatacaaaacgattagtttaagtcttttaaggctattttgacatggttttccttttaattgtggttcacaggaaacagaaactggccatggtataatggaagaaccagaacttactttaataagcaccactgataccagtattgctgaaatggattttgcaaatttaaccctagaagagaagagcgagaatgaagcaaaatgcttctttcaggtaaatttaagctttccttctattttattctattacaagcaaaccagttgatttgtctctta

SEQ ID NO: 283727 - DNA, 472 bp, Homo sapiens
gaaatgtttaaagccttgtgtttacaacttgatttcacttttctttcctcaggttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataaggtgagtataactgagggggaaggacttaatttttcaagcatgaagtacacaactgaaactcaaatttttattccttccacagaaaacactagagaaacttcgagccaaaaatacatgctgactttctagaaatagtgtaaaggttttttaattgtgtatatgtagcattagacaaaattatttaaagtcaataaattgttattcgaggaaaaaaaaaatg

SEQ ID NO: 283728 - DNA, 1800 bp, Homo sapiens
ccacccaaagtccctggggtttctctactggacagcctggcagaagaggccagtgccttagagaacagcaggtggggaggtgagggagggcagaagttggagggaccctggcaagggcctggactctgtcctgagtgatggaagaagccctaacccaggcccccaaggcgccaccagccatagcttcccaagcccaccggtgggaagcagaccaacgcatcgtgtgcccagctgcgcactgccagcccctgcctgcccgccccgcagcgagctcaccatctcgtgaaggatgtcattggtcaggaagctgtcctggacgtaggccatctccacatccatggggatgccatagtcactgggcctttgctggcagggacacagaccagtgagagaagcctcaccagcccgcagcccatggcagctggggacaattggcagtgcccgggctgggaacgggagagtgcacaccccggctcagctctgcaccgggatcggcacctggtggtgggaccagggaggcagtgtagcatccttactgtgggagaggcccagaagagagccagggccctgaaatgacttcccagggctgacctctgacttcagggcaggattggggaatgaagccaggcagggtcaggaagggagccctctttgtactgagcagccaatgacacaacggaggccccacgcccaggacctcaccaaaatatgggcagggcagcagtcacgtccccatttcatagatggagaaactggggccccaactctccagtggagcctggaaccaggggcccctgcctagtcgtgacccaaatgccccagtgctcccgggccccccaggctctcccaacagccccacctacctcgggaggaggcatcacccagaaaggcgagatcttggactcggggcctgggttgccagaatagtaaggggctggcgggagagagggagaggggttggccctgggaggctcggctggcccagcatcccccctccttgctccccccacagccccatcccgcgtacagcagagcagggcgaggcagggctggaagccattgctggagccctgcagccgcagctggtagtccatctgtgcgtcgatgtcctgcagagatggcagcgccgggctgtgtgggtggctgtggtaccagcccaccagggacaggccccgcaggaacaggctctggtagatctggggacagaggcgcagctcagcgggcacaggggcctgaacggctctagtgagcttatgtggctggccagccctgaacgaattcctgctgtgtatcaggcctggggacacagtgatgaccaagacaggccctgcccccaccgccactgagtccagtgggagctggagagacagccaacaaggacctcttttaatataaaagatgcaccctgccacaaagccaggacaccaaagtcattttgttcactgctgtagcccagcttacagaataatggtcgccacacagtaagcactcaacaaacagttaaaactaggctgggagcagtggctcacgcctgtaatcccagtgctttgggaggctgaggcaggcagatcacttgaggtcacgagttcaggactagcctggccaacatggagaaacccccttctctactaaaaatacaaaggttagccaggtgtggtggcgtgtgtctgtactcccatctactgtggaggctgaggcaggaggatgttgaacctgggcagctgatgctgcagtgagccatgattatgccactgcagtccagcctgggcaacagagcaagatcgtgtctcaaagaaaagg

SEQ ID NO: 283729 - DNA, 4196 bp, Homo sapiens
cgaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttaagacgaaaaagagattttctgttatcgggggcagaaagactgaagcacaaaaaaaaaaaaaaagaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagagtatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtttatcaaaggttttgttctgtggcctgaatttactgggtcctacctacacattgaacatgttttgcctgtcttttttttttttttcaacttgccagttcactttacatgttagtataatgtttacacgggtgagttggataaattataaaacatataaattcaaaattggcagatagaatcaccaagtatctatcctcttttactttcaaatgaggaattttgtttttctgaattacacagatcatcacttcctatttcctgttctggacctgtataaaaatgtctacacagtagaagtgacatcaaggtttaataagtatatcaatgattggcacatataaaaattgttgaaccacatactctgaacttggctaatttagttactgcaaggcctccattatccagttttattttttacacgattgaccttgccttgtagctggtgctgtgtagacctgtgttgaaaacacaatcggaatatatgaataattgaataaacagcattatggtgaggcagagacacatggagaagtgttaaaaaaaaaatgggcttcctgcctttctgcctcttttttatgcagtcatctatgttacatctatcctgcctaagaaaaagctgcacatcctaccttcagagtacaaaaaggtacatctgagactcaagactctcactgattggagagcttgtggaaaacaaaacacaccatgccaataaatgagatgaaaacttgagtttgcctttttaactatttatgttctaagttaagctttgataacattcaaatgtcaaattctctcattcttataaaaagttgaattaattgcctgtatttattttagcaattattcaatgtatttccagtataggatgtatagtataattaattttttgtaaataaaatatttttgataagaaaattgcct

SEQ ID NO: 283730 - DNA, 1551 bp, Homo sapiens
tccagtctgggtgacagagcgagacttcctctcaaaaaaaaaaaaaaaaaggccaggggcggtggcttatgcctgtaatcccagcactttgggagcccaaggcgggcagatcacccgaagtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcaaaaacccctatcctgcttttattttcagctaccttgaaagtgagctgaatcaccatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctcagcaccttaaaagcttggatttaatagtaactgggtaaccttaatcagtagtcagaattatcaacactttgctttatttgacacaaccagactttctcagttcctgttctgtatctagagcaacgtcttcatactgttttttcacaaaatttttatttaaaacagttgtgacagccgaaggatttttttttttttttttacaaaattaaaatgaaataacttgtacaactggtgcgtaccatggctccagccagatgcccaaagcactggctattaattcctggagttcagatggtcagttgagtctatcctagttttttgcttcacttgttcaatcatggaactttctagaacgctgccactcttcaaaggcttctcaatttcaaatttgaaaacttaattctctccctcttagtttcaaagttgttacagtgttatctatgtgaagtatgtggaaagttgggggctggggattttcctccaggcagattaagaaacagctctccgggtcgggcgctgtggctcaggcctgtaatcccagcactttgggaggctgaggcaggagaatcgctcgaacccgggaggcggaggttgcagtgagctgagatcatgccattgcactccggggcctgggcgacagagccagacgctgtctcaaaaaaaaaaaaaaaaaaaaggcacggtgactcacacctgtaatcccagcactttgggaggccaaggtggagggatcatgaggtcaggagtttgaggccagtctggccaatacagtgaaaccccatctctacta

SEQ ID NO: 283731 - DNA, 1498 bp, Homo sapiens
tccagtctgggtgacagagcgagacttcctctcaaaaaaaaaaaaaaaaaggccaggggcggtggcttatgcctgtaatcccagcactttgggagcccaaggcgggcagatcacccgaagtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcacatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctcagcaccttaaaagcttggatttaatagtaactgggtaaccttaatcagtagtcagaattatcaacactttgctttatttgacacaaccagactttctcagttcctgttctgtatctagagcaacgtcttcatactgttttttcacaaaatttttatttaaaacagttgtgacagccgaaggatttttttttttttttttacaaaattaaaatgaaataacttgtacaactggtgcgtaccatggctccagccagatgcccaaagcactggctattaattcctggagttcagatggtcagttgagtctatcctagttttttgcttcacttgttcaatcatggaactttctagaacgctgccactcttcaaaggcttctcaatttcaaatttgaaaacttaattctctccctcttagtttcaaagttgttacagtgttatctatgtgaagtatgtggaaagttgggggctggggattttcctccaggcagattaagaaacagctctccgggtcgggcgctgtggctcaggcctgtaatcccagcactttgggaggctgaggcaggagaatcgctcgaacccgggaggcggaggttgcagtgagctgagatcatgccattgcactccggggcctgggcgacagagccagacgctgtctcaaaaaaaaaaaaaaaaaaaaggcacggtgactcacacctgtaatcccagcactttgggaggccaaggtggagggatcatgaggtcaggagtttgaggccagtctggccaatacagtgaaaccccatctctacta

SEQ ID NO: 283732 - DNA, 1497 bp, Homo sapiens
tccagtctgggtgacagagcgagacttcctctcaaaaaaaaaaaaaaaaaggccaggggcggtggcttatgcctgtaatcccagcactttgggagcccaaggcgggcagatcacccgaagtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcaaaaacccctatcctgcttttattttcagctaccttgaaagtgagctgaatcaccatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctcagcaccttaaaagcttggatttaatagtaactgggtaaccttaatcagtagtcagaattatcaacactttgctttatttgacacaaccagactttctcagttcctgttctgtatctagagcaacgtcttcatactgttttttcacaaaatttttatttaaaacagttgtgacagccgaaggatttttttttttttttttacaaaattaaacactggctattaattcctggagttcagatggtcagttgagtctatcctagttttttgcttcacttgttcaatcatggaactttctagaacgctgccactcttcaaaggcttctcaatttcaaatttgaaaacttaattctctccctcttagtttcaaagttgttacagtgttatctatgtgaagtatgtggaaagttgggggctggggattttcctccaggcagattaagaaacagctctccgggtcgggcgctgtggctcaggcctgtaatcccagcactttgggaggctgaggcaggagaatcgctcgaacccgggaggcggaggttgcagtgagctgagatcatgccattgcactccggggcctgggcgacagagccagacgctgtctcaaaaaaaaaaaaaaaaaaaaggcacggtgactcacacctgtaatcccagcactttgggaggccaaggtggagggatcatgaggtcaggagtttgaggccagtctggccaatacagtgaaaccccatctctacta

SEQ ID NO: 283733 - DNA, 1494 bp, Homo sapiens
tccagtctgggtgacagagcgagacttcctctcaaaaaaaaaaaaaaaaaggccaggggcggtggcttatgcctgtaatcccagcactttgggagcccaaggcgggcagatcacccgaagtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcaaaaacccctatcctgcttttattttcagctaccttgaaagtgagctgaatcaccatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctcagcaccttaaaagcttggatttaatagtaactgggtaaccttaatcagtagtcagaattatcaacactttgctttatttgacacaaccagactttctcagttcctgttctgtatctagagcaacgtcttcatactgttttttcacaaaatttttatttaaaacagttgtgacagccgaaggatttttttttttttttttacaaaattaaaatgaaataacttgtacaactggtgcgtaccatggctccagccagatgcccaaagcactggctattaattcctggagttcagatggtcagttgagtctatcctagttttttgcttcacttgttcaatcatggaactttctagaacgctgccactcttcaaaggcttctcaatttcaaatttgaaaacttaattctctccctcttagtttcaaagttgttacagtgttatctatgtgaagtgggtcgggcgctgtggctcaggcctgtaatcccagcactttgggaggctgaggcaggagaatcgctcgaacccgggaggcggaggttgcagtgagctgagatcatgccattgcactccggggcctgggcgacagagccagacgctgtctcaaaaaaaaaaaaaaaaaaaaggcacggtgactcacacctgtaatcccagcactttgggaggccaaggtggagggatcatgaggtcaggagtttgaggccagtctggccaatacagtgaaaccccatctctacta

SEQ ID NO: 283734 - DNA, 1497 bp, Homo sapiens
tccagtctgggtgacagagcgagacttcctctcaaaaaaaaaaaaaaaaaggccaggggcggtggcttatgcctgtaatcccagcactttgggagcccaaggcgggcagatcacccgaagtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcaaaaacccctatcctgcttttattttcagctaccttgaaagtgagctgaatcaccatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctcagcaccttaaaagcttggatttaatagtaactgggtaaccttaatcagtagtcagaattatcaacactttgctttatttgacacaaccagactttctcagttcctgttctgtatctagagcaacgtcttcatactgttttttcacaaaatttttatttaaaacagttgtgacagccgaaggatttttttttttttttttacaaaattaaaatgaaataacttgtacaactggtgcgtaccatggctccagccagatgcccaaagcactggctattaattcctggagttcagatggtcagttgagtctatcctagttttttgcttcacttgttcaatcatggaactttctagaacgctgccactcttcaaaggcttctcaatttcaaatttgaaaaatgtggaaagttgggggctggggattttcctccaggcagattaagaaacagctctccgggtcgggcgctgtggctcaggcctgtaatcccagcactttgggaggctgaggcaggagaatcgctcgaacccgggaggcggaggttgcagtgagctgagatcatgccattgcactccggggcctgggcgacagagccagacgctgtctcaaaaaaaaaaaaaaaaaaaaggcacggtgactcacacctgtaatcccagcactttgggaggccaaggtggagggatcatgaggtcaggagtttgaggccagtctggccaatacagtgaaaccccatctctacta

SEQ ID NO: 283735 - DNA, 672 bp, Homo sapiens
tccagtctgggtgacagagcgagacttcctctcaaaaaaaaaaaaaaaaaggccaggggcggtggcttatgcctgtaatcccagcactttgggagcccaaggcgggcagatcacccgaagtcaggctggtcttgaagtcctgacctcagtgatccactcgcctcagccgaagtgctgcgattacagacctgagccactgcgcccagccttgatcttgaggtttcctgggagaaggtggcttaaggctgagacacttatgccctgggccagccactggattcctgtgctctgcttcactcctagttaccagaaaggtggaatctggatgagtggaggccccagcggaaaggcgcagatacccggagacttcccagagagactcgacccaccaaaaagcgcaccgcggccgcgcagcccttccttcagctctggaacccagcgccccacacctcaaatgggagaactggtgacctctagtggcccatgaccagcctgcagggcctggggctggcggggattctctgacccaaactctcctgggctctaatgctgttcccctgcccaccctaccttctgccttcacactgctgaggggtccatagccgacaaggaagagctcatttctcatttgtcatgaccatctttaataaaaaataaattagttctgggtgg

SEQ ID NO: 283736 - DNA, 666 bp, Homo sapiens
agagacggggttttgccgtgttggtcaggctggtcttgaagtcctgacctcagtgatccactcgcctcagccgaagtgctgcgattacagacctgagccactgcgcccagccttgatcttgaggtaagagggtactgtacagcagttactctatcataacacctaaataatacctaaagttaaagagttttgatgaagttcttggcagcagtgcttttccccttctgctttccaaaaggaggtaaaaagaagccagtcaatttcaaaaacccctatcctgcttttattttcagctaccttgaaagtgagctgaatcaccatggaaatgtgcaaatgtgaggtttgcatacttggttttaagccctgagcaccatatgctaatcaggcaatcaggattctgtgcctccctgcagtcagttgcatttctatttaaaagtgcattttggtttggaagcccctttctggagcctaactaccaaaaggcagcaactttttgtatcattacaaagaaagctgtgtaagtgcactcccaagcaaaggtgtggtaggagagtagcagccacagaggacccaagcccaagtcttggcctgagttaagttagtgctattgctcccattgacgtgctatgatgtgaagccgtttctggtacagtgttcctttgctca

SEQ ID NO: 283737 - DNA, 6831 bp, Homo sapiens
aatctcccaaggcctaaggaggcaagaggcctgcaaatcgcctcctgctcagcaaacgggttgctcagcaggcccggggtcctggtccaccccaggtccctggtttgcccacctccgatggcggccttcgctggcagggtgggcgcctctggggagccagctccgtcccggcgcctttagagccccatctcttccacgtccctggccttcctccccttccaggcggctgtccccgccggggtccagatggtgtcggagggccggcggttcgacggcgggcccggggttcagcctcccggcctccctccgtccctgactctcctttcttcggagagggcgcgggggccggggccaaagcgccgctcttggggttctcctggactcggagttgccccaggcgggcgcagctctgccccgcggggtgccagcctcgggcgggcaaggtccgtgagtcaccgcctgtaaccgaacaccaggcctccctgccccctcccccagctccggccgccaggctgcggcgacacctacaagaaaatgaaggggcgcccaggcccgcggcggccccggccgtatcgcgagcaggtcccggcggcccccggctcgcggcgctctttcttccccggccccggggctcggccagccgcaaccgccgccccggcgccagcaggaatccaggccgagcgaccggccccggagcccgaggcggcggagggcccgcggtagctgcgactggcgagcccgagagcgcccggggagggggcgcccggcttggaatttcccggtcccttccggcccagcgaggacaaagcactcctggccgccgccgccgccgccgccgtggcctacgccgcgccgcacaaagggcgagtcgcgacacgctcccatccccctcccagctcacggcggccccggccccgggtggctgcagggaggtgggggaagccctggctgcaccgcccctcgctccccctcccctggggccgcgcgagcgccgcccccgccccgtctgcgcgtcctcccggggaggggttggggggcgcggcgccccacataacactccccctcctgcgctgcgagccaccctctcccctccctcctgcaaacaccaccgcctcccctgccaccgccgccacctcgcccgacgctccacagctcgccgcggccggggggcggtgcgcggaccgtgcgcgccgcgggcgccagatgtgcagtccccgccgccgccagtgaccgagccgcagtccgagcggtatcgggccgcctccctgatgctgcgggggcgaccttgagcgtacagcggcttccctcggtggggaccccgacatcccagcgctgtgcccggtcttgccctctgtagcccggctcgccccgcgcttggacatggaaggggccgccgcgcctgtggcgggggaccgccccgacttggggctgggggcgccgggctctccccgagaggcggtggcgggggcgactgcagccctggagcccaggaagccgcacggggtgaagcggcatcaccacaagcacaacttgaagcaccgctacgagctgcaggagaccctgggcaaaggcacctacggcaaagtcaagcgggccaccgagaggttttctggccgagtggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaagtcatccagatgcttctggaggaggggcaggagacacttgggctgtttgccttgggtgagcccaaagaacttgccccttttctccttgcattagcaagctaggtctggctgcgtggagctggcaagtagatttcagcaacttgagcttgagttgatgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctgtgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggacgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggtgggggtgtgggtgcatggaggacaacctgcaactctgagctccctacttcctgcctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtagtttccatcattctagtctttaagtaaaaatgacactattgaggaaagtcagtctactcccttcttcctccccccaaacacgtgttctcttttgtcaggaaactcagccagtggactgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactgaaaaaaaaaaat

SEQ ID NO: 283738 - DNA, 2874 bp, Homo sapiens
aatctcccaaggcctaaggaggcaagaggcctgcaaatcgcctcctgctcagcaaacgggttgctcagcaggcccggggtcctggtccaccccaggtccctggtttgcccacctccgatggcggccttcgctggcagggtgggcgcctctggggagccagctccgtcccggcgcctttagagccccatctcttccacgtccctggccttcctccccttccaggcggctgtccccgccggggtccagatggtgtcggagggccggcggttcgacggcgggcccggggttcagcctcccggcctccctccgtccctgactctcctttcttcggagagggcgcgggggccggggccaaagcgccgctcttggggttctcctggactcggagttgccccaggcgggcgcagctctgccccgcggggtgccagcctcgggcgggcaaggtccgtgagtcaccgcctgtaaccgaacaccaggcctccctgccccctcccccagctccggccgccaggctgcggcgacacctacaagaaaatgaaggggcgcccaggcccgcggcggccccggccgtatcgcgagcaggtcccggcggcccccggctcgcggcgctctttcttccccggccccggggctcggccagccgcaaccgccgccccggcgccagcaggaatccaggccgagcgaccggccccggagcccgaggcggcggagggcccgcggtagctgcgactggcgagcccgagagcgcccggggagggggcgcccggcttggaatttcccggtcccttccggcccagcgaggacaaagcactcctggccgccgccgccgccgccgccgtggcctacgccgcgccgcacaaagggcgagtcgcgacacgctcccatccccctcccagctcacggcggccccggccccgggtggctgcagggaggtgggggaagccctggctgcaccgcccctcgctccccctcccctggggccgcgcgagcgccgcccccgccccgtctgcgcgtcctcccggggaggggttggggggcgcggcgccccacataacactccccctcctgcgctgcgagccaccctctcccctccctcctgcaaacaccaccgcctcccctgccaccgccgccacctcgcccgacgctccacagctcgccgcggccggggggcggtgcgcggaccgtgcgcgccgcgggcgccagatgtgcagtccccgccgccgccagtgaccgagccgcagtccgagcggtatcgggccgcctccctgatgctgcgggggcgaccttgagcgtacagcggcttccctcggtggggaccccgacatcccagcgctgtgcccggtcttgccctctgtagcccggctcgccccgcgcttggacatggaaggggccgccgcgcctgtggcgggggaccgccccgacttggggctgggggcgccgggctctccccgagaggcggtggcgggggcgactgcagccctggagcccaggaagccgcacggggtgaagcggcatcaccacaagcacaacttgaagcaccgctacgagctgcaggagaccctgggcaaaggcacctacggcaaagtcaagcgggccaccgagaggttttctggccgagtggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatataccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactgaaaaaaaaaaat

SEQ ID NO: 283739 - DNA, 4593 bp, Homo sapiens
tggccatgttaagcagcctctgctttatgaaaaaacaaaaacaaaacaaaacaaaaacaaaaacaaaaccaccatcacaaatcccaggctgtcaaacctgatgttttctgttgccaggagaagggtgtttttgctgtgtatgaaagacatgacaagggggcatttccaagctttgttttggttattgtcagttctgccaacaagtaacatctgtatttattttccaaactcccccaatggctgatttgcatctgtttagctctctgaataacatttcatttcctgactttataggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaagtcatccagatgcttctggaggaggggcaggagacacttgggctgtttgccttgggtgagcccaaagaacttgccccttttctccttgcattagcaagctaggtctggctgcgtggagctggcaagtagatttcagcaacttgagcttgagttgatgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctgtgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggacgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggtgggggtgtgggtgcatggaggacaacctgcaactctgagctccctacttcctgcctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactgaaaaaaaaaaat

SEQ ID NO: 283740 - DNA, 1121 bp, Homo sapiens
tggccatgttaagcagcctctgctttatgaaaaaacaaaaacaaaacaaaacaaaaacaaaaacaaaaccaccatcacaaatcccaggctgtcaaacctgatgttttctgttgccaggagaagggtgtttttgctgtgtatgaaagacatgacaagggggcatttccaagctttgttttggttattgtcagttctgccaacaagtaacatctgtatttattttccaaactcccccaatggctgatttgcatctgtttagctctctgaataacatttcatttcctgactttataggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagaccctccagaaagctcttggaaggagaggtgcatcatagagcaagattgaagagttcctggatcctggccataatatcagatgaggaaacacttttggaaaagtgcagtaacttgcccaagtcaaccaactgttaaatgtgcatctggattcaaatatgggcctgggtgactgactttcaagtccaagctcttagttgctctgttgggaatcagggatgatgattctgcaactca

SEQ ID NO: 283741 - DNA, 736 bp, Homo sapiens
tgcctttttttcttttttcaaagcatcagggttcttcgagtaaacgactctggccatgttaagcagcctctgctttatgaaaaaacaaaaacaaaacaaaacaaaaacaaaaacaaaaccaccatcacaaatcccaggctgtcaaacctgatgttttctgttgccaggagaagggtgtttttgctgtgtatgaaagacatgacaagggggcatttccaagctttgttttggttattgtcagttctgccaacaagtaacatctgtatttattttccaaactcccccaatggctgatttgcatctgtttagctctctgaataacatttcatttcctgactttataggttgctataaaatccattcgtaaggacaaaattaaggatgaacaagacatggttcacatcagacgagagattgagatcatgtcatctctcaaccatcctcatatcatcagtatttatgaaggtcagtgatttttttttttttaacccccatatcagttaccatttctcataccatggggcctgccaagactttgagataattgcccttctgggcagaagccaagtatttttcctcatgatgcaaaaatagtcgggtgttatctcttacttggttaccttgaacacaaccagacacatgagtgcagctcattttggtcataaaatatctctggcggataccttattctgtcttcttaattccttggcagttgctaagcaacccaccttattga

SEQ ID NO: 283742 - DNA, 5505 bp, Homo sapiens
tggccatgttaagcagcctctgctttatgaaaaaacaaaaacaaaacaaaacaaaaacaaaaacaaaaccaccatcacaaatcccaggctgtcaaacctgatgttttctgttgccaggagaagggtgtttttgctgtgtatgaaagacatgacaagggggcatttccaagctttgttttggttattgtcagttctgccaacaagtaacatctgtatttattttccaaactcccccaatggctgatttgcatctgtttagctctctgaataacatttcatttcctgactttataggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaagtcatccagatgcttctggaggaggggcaggagacacttgggctgtttgccttgggtgagcccaaagaacttgccccttttctccttgcattagcaagctaggtctggctgcgtggagctggcaagtagatttcagcaacttgagcttgagttgatgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctgtgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggacgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggtgggggtgtgggtgcatggaggacaacctgcaactctgagctccctacttcctgcctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtagtttccatcattctagtctttaagtaaaaatgacactattgaggaaagtcagtctactcccttcttcctccccccaaacacgtgttctcttttgtcaggaaactcagccagtggactgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactgaaaaaaaaaaat

SEQ ID NO: 283743 - DNA, 4138 bp, Homo sapiens
  misc_feature (4058)..(4058): n is a, c, g, or t
tggccatgttaagcagcctctgctttatgaaaaaacaaaaacaaaacaaaacaaaaacaaaaacaaaaccaccatcacaaatcccaggctgtcaaacctgatgttttctgttgccaggagaagggtgtttttgctgtgtatgaaagacatgacaagggggcatttccaagctttgttttggttattgtcagttctgccaacaagtaacatctgtatttattttccaaactcccccaatggctgatttgcatctgtttagctctctgaataacatttcatttcctgactttataggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaagtcatccagatgcttctggaggaggggcaggagacacttgggctgtttgccttgggtgagcccaaagaacttgccccttttctccttgcattagcaagctaggtctggctgcgtggagctggcaagtagatttcagcaacttgagcttgagttgatgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctgtgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggacgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggcgacttctcnacactgcatagcatgccaacttcagctgcacatggccgcctccatctctacacaactttgagtcacataaatgtcacgtg

SEQ ID NO: 283744 - DNA, 829 bp, Homo sapiens
gagagagaccccctcacttcacactaccgggaaagggtaagagaaaggagagaaaaggtcacaggtcagagaagacagatgaattattaatcccagagccaaagatgccctctcgtggttttactgcagtgcagaaagcaagccaccgccaagcctgggagcccatcaccagtgtctgttcaagcggaatcctttgcccactagctttcttcaacatcccaccagaaataactattgaaaggaaaggtgcaattaaatctaagtctctacactgttaggagagggagaatgtggtgaggtgctgtagttatgagattggattatttttccctgaaaaaaatctgctggtatcaactcaatgaaatgtgtaactccaatggtacagacaagcattcactatcctgcagggacaagccacttttagagataatagggcaatacagatcttacttaacctctcccacatctaaacactaaaactgctgaagtggcagcaaattaaaaaaaaaaaattactatgctaaactaaatgccaattaagaaatgaaaaggccgggcactgtggcttacacctgtaatcccagcacttggggaggccgaagcaggcggatcacgaggtcaggagatcaagatcatcctggctaacacagtgaaaccccgtctctactaaaaatacaaaaaattagccaggcgtggtggcgggcgcctgtagtcccagctactcgggaggctgaggcaggagaatggcgtgaacccgggaggcagagcttgcagtgagccgagatcgcgccactgcactccagcctgggcgacagagcaagactctgtc

SEQ ID NO: 283745 - DNA, 472 bp, Homo sapiens
tgtggtgaggtgctgtagttatgagattggattatttttccctgaaaaaaatctgctggtatcaactcaatgaaatgtgtaactccaatggtacagacaagcattcactatcctgcagggacaagccacttttagagataatagggcaatacagatcttacttaacctctcccacatctaaacactaaaactgctgaagtggcagcaaattaaaaaaaaaaaattactatgctaaactaaatgccaattaagaaatgaaaaggccgggcactgtggcttacacctgtaatcccagcacttggggaggccgaagcaggcggatcacgaggtcagaagttcgagaccagtctggccaacatagtgaaaccctgtctctactaaaaaaatacaaaaaaaggccgggcgtggtggcgggagcctgtaattccagctactcgggaggctgagacaggagaatggcgtgaacgccgga

SEQ ID NO: 283746 - DNA, 377 bp, Homo sapiens
attgagtttttaaggcacccaaataattgaagcctaagatatattaagacaagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattta

SEQ ID NO: 283747 - DNA, 3298 bp, Homo sapiens
tgcttacagctgagaagcaggtcagtcaggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcgtcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaaggaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattta

SEQ ID NO: 283748 - DNA, 3386 bp, Homo sapiens
tgcttacagctgagaagcaggtcagtcaggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcgtcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaaggaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattta

SEQ ID NO: 283749 - DNA, 3236 bp, Homo sapiens
tgcttacagctgagaagcaggtcagtcaggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcgtcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaaggttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggtaaaaaaaaaaagttaaccaaagaatatacctgtacataatttgtacagttttaagttgttagataggaactggatttcttatgtattagacattattgctcaatcataatggaatagattctgcatccctaaatgtatgaaccataaggttaaaaaagatgaatggaaatatcaaacaactttttactgagcatcagtttcataatcaataatataagaagattaatttggattctagtatgtttcagtttgtttttaattaccaccttcctttggtagaaaaaatatgttccttgatgtaggaaagtctaggttttagagattagaggatgagatcaagagttaaattcctaaagaagcactgaatatatgaagagagcaaacaaatcaagtaccaacctagaggctttatttttgaattgattcatggtgtgtgtgtgtgtgtgtgtgtgtgtgtgtgtgtgtgtgtaacacagaaacagcttcagaaaataagggatagaaagtaatgaagaaagtacttaccccatattgccataaaaatagcaaagaagactgtccctccattatcgaacaaatatgtcacctgagtagaaaacaaacagaaatattagtcatgcaaattgattataataagccagtgaatactgtttgcactcaggtactatgattttttctcaaatagaatcatattattttatagtacagaaatattatatatgaattcctttcatgggtcttgcaacaatttcacatgatttttctcatggggagaggtgaagaaacaacattagccctcttctctcctctcttgattccctttataccccaccatcatttctgattataaataattctaccattctatggaagtatttgtgggtcacagattgtcaaactacttaatgaaagttgtatgaaattagtttttcaggtgaggcattcctagttgcaattcctgttagcaaaacttctaggagtggggaagttggaaaatgcaggattcttccagtgagccagcatttcccatagctaaccctattctcttagtctttcaaaatgtagaatgggtccaataatggctataagatgtaataaatcccatcttaatttgttttaaaagtttcataaatcactgaacacttatgaaacaaagtgttttttaatcagatatcaactgaaacttcataaaggatgcatagttttataatgttattgaatcaaattttaaggcttgtattgtttgattttaataaagtataaattcaattta

SEQ ID NO: 283750 - DNA, 750 bp, Homo sapiens
tagacacacagacacatccaagaagaaaagtcaaatagatagttgaaatccagtgttcccagggtatgtgggctaaatatattttgggcttctatcagcatatagatactagactaactgagatcaggagtcactgcagatagagcaggggtccagaattgaacattgggacattccaaatttagaggttggaagaatgaggaaggaccagtggacatgaagagcagcaaggcagaagtgagatactgaaagatgggaagttcataaggaagaaagtgagcaattcatcaaattctaacatgggattgaaaattgatcacaggaagtggttgcatgaggctggagtaaagggagttgcggacaaggcagcatggtgaccagcagagtgaggaaaggagatgaaatagagaaataaagaccagatgcgtctcagtccgtcacctcagacacatgactcggggctgaagagtggggaagggccctgggtcccagccacatgctatcaccaatgttgctaagcactgcttttaagactcccagggcactgcatgaaaaaacagcaactggccccttccataatcagcaatttgcaatatacagtgtcctacaagatagaatgccacaacagatgattatctggtcaaaaacagtctttgtacaggaataggttaaagcaagagttctttgattattgttttggcagaaaaaggcaaagtgaaaaacaattccagaaaaaaaagttacgaagca

SEQ ID NO: 283751 - DNA, 753 bp, Homo sapiens
  misc_feature (57)..(57): n is a, c, g, or t
gggtgaaatctcctgtcttgaggctcgggagctagtcggtgtactacaggctggcgnatagcgtggtcccgtagcgtataattacgggatcatgctaactagctgatgttggccatgcagcacgctagtaacttaacatgcactcgacggggtcacgtacacgtttctggaattacgttcctcatggcggtccggaacgttcaattaccgaggtctggtcctgcggggactccaagccagactagctgtgactgggggaggagagagcacaaacggattcatcctccttctgccactgcccaacaattgaagaccaccaactgaagagaaacaactgagggtaccaactgagtgcactaaccgaaggcaaccaatgtgggcatccactgaaggccaccaagtgaaggccagttgccctgccaaccagaccacatcctggttcagaggaaacaatcaggtccagaatcccctgcatgcatccccacaatcctggaacttgagagcacaggcatatggctcacaaggccctgccctgccagcagccccgccccacctttcattcatgctggctgctaggaccttttcaggtttctcactgtgatgaagtacctagggcatcatcaccttacaatgaatgatgctaaaattactgaaaccaaatctgcctcatgcagtgtctgagattcatagaaccgccatttctccataatctctgaaacatcaacaaactagaaataagagagatttctgcag

SEQ ID NO: 283752 - DNA, 707 bp, Homo sapiens
gggcattctcctgcttcagcctctggagtagccgtgactacaggcacccgccaccgcgcccggccttaactaggattttctagactatgttccaggagaagtagaattactgcatcacagggcacttcatttttagattacgtatcatggcggcagaccttcaataccaaggagggcctgggggcaacaagcctgagagctgtgactgggggaggagagagcacaaacggattcatcctccttctgccactgcccaacaattgaagaccaccaactgaagagaaacaactgagggtaccaactgagtgcactaaccgaaggcaaccaatgtgggcatccactgaaggccaccaagtgaaggccagttgccctgccaaccagaccacatcctggttcagaggaaacaatcaggtccagaatcccctgcatgcatccccacaatcctggaacttgagagcacaggcatatggctcacaaggccctgccctgccagcagccccgccccacctttcattcatgctggctgctaggaccttttcaggtttctcactgtgatgaagtacctagggcatcatcaccttacaatgaatgatgctaaaattactgaaaccaaatctgcctcatgcagtgtctgagattcatagaaccgccatttctccataatctctgaaacatcaacaaactagaaataagagagatttctgcag

SEQ ID NO: 283753 - DNA, 319 bp, Homo sapiens
taacatgaatgactcagattctgaaggaagaaaaagaatgacaaactatgttccaggagaagtagaattactgcatcacagggcacttcatttttagattacgtatcatggcggcagaccttcaataccaaggtgcatcttctcccgcaagttcttcagcatcctttccagaagcattcggcagccgagaaagcaggctacaccttacctactccttcctgggctaaagatctcagacttagttgcttatcttaatttggggaaaataaattaaggagttcttctatcattaagcacaacataatataatctatttaat

SEQ ID NO: 283754 - DNA, 283 bp, Homo sapiens
ttggaataccttgtctcctccatgtcctctctcatagcatgacagcagggctctgagatggaactttccaagcatatttcttaaaaaatagaatctgcagatctcttaaggccaagctttggaagttgcaacattgtcacctctgctgcattctgtggtcaaagcaagtcataagacaagcacaattcaagaggagggaaagggactacctgtggatgggaggcagagcagataatttgcagctgtctttaatccatcacagctgattgaggcaggtatgaaa

SEQ ID NO: 283755 - DNA, 919 bp, Homo sapiens
gccggacacgagctctgcgaatcactttattgcgcgcgtttcggggagcgggccgtccagggaaggaagcaaagcgggaacgcactgcaggccccatccagaaatagcagatgccaacggaatccaagaataaagtcgtttattatttttccaagaataaagtcgtttattattttcagagcggcgggagtagggctggggaccctagggccgctccagtgggacttccctgaacccggttgtagaggatgatggcgcctttggccgaggggcagagttcagcccacatctccgtctcgggcaatctccgcacgttctgtggggagacaacgagacccaggcattcaagcttgccacttctcctgccagggctgtgcccagaattcctgagcctcagagacctctgcactgtccttagggaggcatgttaaggggctgaacatgtccctggacctttcccttgcactgagggcaaatcttgtgactctggagggaattgtgacccagccaacaccttctgcaggccccagccctggcctccaagcaagatggtttgtcactctgcacctgtgtctccacaaagaagattcctgtagactcgtgggcctcgggtcccccactcaggtagtgcttcctcacctgctcagaagtcaggctgcacctggacaagaacacaagggtggcttagtgggtgaccagcccctgcggggtacctgtggagccacagctgcctcagcccactcctcaccacccaccttcccaagacccaggatcatgtacccgagcctactcactggacatagaactcggcactggctcggccagcactggtctcatttcgggcgatgcccaacagcaggggctggctcagggtgagcagcggcaggttcacctgcggtggagggtggggtggggggag

SEQ ID NO: 283756 - DNA, 323 bp, Homo sapiens
cctcccaaagtgctgggattacaggcgtgagccactgcagagagattctctacgtgggttctagtcgtggctctggcatttacttgtgggacctctctgaactgcaaactcctagtgagttgagctagattttgtggcggggtcatcaccaacagccctagcgcaaggaagcaggaagtccccaaccaatcccatagccaccctaccccaacgtagggaatctgaacgccaagaaggggctggggtggccagtaaccgaaatcaggtgtccagttctcagccctccccaggcatttaatacatagaactaacccttccgtccc

SEQ ID NO: 283757 - DNA, 1372 bp, Homo sapiens
ggtattctctgttgtacaaattaagggtggacaaggggggttccaagcacctttaggttcatactccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaataagttcattgaagataaagcaaaagtaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagtgatggggcaggggactgttaggatgcattataaactgaaaagcctttttaaaattttatgtattaatatatgcattcacttgaaaaactaaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaacacacaaaaagacgaaaaaaaaaacaaaacaagagcaaacacaagcaacaaacaacaagagacaaaagggagggacggaaaagaaaaagcacccaggagggggcaacaagataggcgagtaccccagaatctgtgagacaaaagggggcccaaaaagaggccgaaaaaaaaagaaagacaaagacagaggaaaacacacagcgtccccacgagacaaacatggccaaagagaggaccctgcgagaaacaacccacaacaagcaggagaggacaaaaaatgcgggaaaacaacacaaaaaagaacatgacaccgccac

SEQ ID NO: 283758 - DNA, 1158 bp, Homo sapiens
ggtattctctgttgtacaaattaagggtggacaaggggggttccaagcacctttaggttcatactccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataatactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagtgatggggcaggggactgttaggatgcattataaactgaaaagcctttttaaaattttatgtattaatatatgcattcacttgaaaaactaaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaacacacaaaaagacgaaaaaaaaaacaaaacaagagcaaacacaagcaacaaacaacaagagacaaaagggagggacggaaaagaaaaagcacccaggagggggcaacaagataggcgagtaccccagaatctgtgagacaaaagggggcccaaaaagaggccgaaaaaaaaagaaagacaaagacagaggaaaacacacagcgtccccacgagacaaacatggccaaagagaggaccctgcgagaaacaacccacaacaagcaggagaggacaaaaaatgcgggaaaacaacacaaaaaagaacatgacaccgccac

SEQ ID NO: 283759 - DNA, 795 bp, Homo sapiens
ttataagtagcaggatattctgatggagtttgactttggttttgggcccacggagtttcagatgcctttgagaaatgaatgaagtagagagaaaataaaagaaaaactagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctactcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctggaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttct

SEQ ID NO: 283760 - DNA, 1707 bp, Homo sapiens
caggaaggattcagacaactctgcctgggagtgagggctctgctcagcggcctagacctgggcacaacggagcaggccactccgtttctcatcacagacctgaaggcagatggcctgggcgtcgggcttcctctgctctctggcggggcgattttcacggtcaccaggctgcggacaggctgtgggggtggcgggcggtccaaagccaccgcttcacgtaggccaggggagccttggagaaatcaggcctgatgttgctcagcagcggcagcctgttgggaaagcacctccaggcctcggggaccatctctctcaggacgcggatgcgggcggggaccatctctctctggatgcagatgcgggtgtagtcccagctgggaggagtggtgcggaggggccggatgcggacccagtgcttcctgtggaagtaggtgaccttgcagttctcctggacctgggagctgaggaagggcctggactgcagaacccagtgcttttgggcggggcgcagctttctggcaagcggcttgggccttccagtagacactgggctgccagaagtttccgaaatctgcggtcaaggccagagatcaaatgtcagggctcagtgactagcgacggttggcatcaaaatgttggaaagtgcacaaggcgccgtgtgccaggtacggtctgtccaccaactgttgcatggggcaggaggccacggccaggccacagctttgccgcgcgcagctgcagaaggggcaagtagcgccccatgctgtctggaggaccaaggaggctcaagcctgtccttcccactcatggtcccagacacttagctctgggcagaggggcctggcagctgtctctgcttttgtacctgacctttaaaggcagaacatagaagaatttctgccaggtcctgaaaactgcagatacctgttgacagaagggtgctctctttgatcagtgtgaaaatgatcacaatacacttggaggctcttttaaggaaaaacaaatcatttgctcatattcgtctaggatgactgttaatatcactttttgcaattttgctcttaagaaaacggtgaaagccatcaggatttatgttttagtacctgtaatgctgattttatgttgaccctcataattttcagtgttcacacagccatatatacataatcttctctaaacactaatgccatttctgtcctttcatttctattggtaatcctggagtagagtgaggcacattttccactaatagctgaaaagatctaacttcaaaaacaaagaatccaaaggctgcttagtaactgtagtgcctaagtttagagtctgttcaaggtggtgtgaaaagttttttggggggggggcatttccctcaaaagcacgtggagaaggaacctattgaccctctggaatgccagaatcgggaagagacaaaaaagtcgcaaccaattgaagattgggcaatagatttggcccagactgaggcagatgggtgaatagtaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataa

SEQ ID NO: 283761 - DNA, 651 bp, Homo sapiens
ttttcttaaaggcaagagtctcgctttgtggcccaggctggagggcagtggcaccatctcagctcactgcaacctccgcctcccaggttcaagagattatcgtgcctcagcctcccgagtagctgggactacaggcatgaaccaccacacctggcccctgcatagttcttaacaaatccatctttgagtcttttttccatgctgggcactgtcctagatgctttatgtaagttaattcattatgctgctgagaggtagcagagttcctaatttactgcttactagctataagagcttagataaattatttaacttctctgtgcctcagtttcctcaagtttgaggaaatgggaataacagcagtatctgccttaagcgttgctttttgaggactaaaaggtatttggtaagggtttagaaaagcacatagcaagtattcaatatatgttagctatactgattaaatataatcaaccgtgagatagattttcccccacttagagaaaaggaaagtatttgggaaggttaagcaagttttccaaggtcattcaaacggttacatggcattgttaaataggtttgcaacttggaactgagtatctgaaacctggattctcccatttcttcaaggctacactgctgaaatcagga

SEQ ID NO: 283762 - DNA, 8744 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283763 - DNA, 239 bp, Homo sapiens
ttttagtgcaatggcttggcagagaagaaacagcacaggactcgagtccatacacctgcattttagccctggctctgtcattgaatgtgtttgacctggggaaatttgttcaccatttttgatttcaggtttctcatatgacgtcttcttccaactttaatatgctactcaactttctgttttctcctgtaggacagcctcgggggtaacagcaagttgagtagcatattaaagttgga

SEQ ID NO: 283764 - DNA, 7954 bp, Homo sapiens
ttttagtgcaatggcttggcagagaagaaacagcacaggactcgagtccatacacctgcattttagccctggctctgtcattgaatgtgtttgacctggggaaatttgttcaccatttttgatttcaggtttctcatatgacgtcttcttccaactttaatatgctactcaactttctgttttctcctgtaggacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283765 - DNA, 9240 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgcaaaaaaaaagaagcaagaatgaaaaaaacaagatggaaaggacgacgacaaaagagagaaggagacggggaaaacacaaaaagaagagaacaaaaaaaaagtgggggggggggcgcaacccacaaaataaggtattaaaaaccaaggtagcttgggcggacgcaccaaaaaaggtaggaagagcgagtgacagacgtgctaacccaaaaagcacagcggcaacagagcgggggcggaccccacaaaaaaaccgcgcggggagcaccatgtgttgcgaaccaaccacaagagggggggatgcatacgtgggaacaaacagagcggcgaggacataaaaaccacccggcggggaggaagacgcagccgaggtcacgctagaccacggagacagaccaagacgaccgaagtctgaagctagacgaagctagccaaacgaagaaggaagaagctgcacagcaatgagacaaacaacatgcagatgagacaagaacacatag

SEQ ID NO: 283766 - DNA, 4622 bp, Homo sapiens
gcaaacagtctgatttaattaggaagttaaataagttgaggtggggtggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283767 - DNA, 8424 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccagagccggggataagatcctgctagagtcacccacc

SEQ ID NO: 283768 - DNA, 6611 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctacctgtaagatcctgtagagtca

SEQ ID NO: 283769 - DNA, 1406 bp, Homo sapiens
atagaggatccctctctttcagtcgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283770 - DNA, 1406 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagtaagtttgttttttttcccttcctggcatacttttggtggttggcaagaaggaagaaaaaagagtagactgttaatcccctttccaggtatcatttcctctatcggtgtgcaaatgtataattattaggctcttatggtaatgacatttttgatggaataaacataggttttttcctagcaattcacatcctagcttactagaacctggatgcagtggggttgctggacgcacacggaatcacacgattgcttctggagatttaggggagtagagaaagggcctcctgctaatctgaccactgtgtgagtcatggaggaggagcctctgctggcctcacactcagctggccaccctggccttccacagactccttttgttgggctaacattttggagcttgttttctgtttaactttgggaca

SEQ ID NO: 283771 - DNA, 8844 bp, Homo sapiens
cagacggaagccgaacgagttcctcggcggctgcaggatgggggactccaaagtgaaagtggcggtgcggatacgacccatgaaccggcgagatttgactgtaaggagccagctgatacaatatggtcagattccattaagcagtggttttaagaaactctcatggacctctgggcctgaggaagtgaagagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283772 - DNA, 5358 bp, Homo sapiens
gactctagagttatccacctgctggcccttacgcgcagcttctggagatgcgtttgaccctaactgaggagtgtaacgcggtgatggtcccctctgctggcagtgggattccagtggccccagcagaatgccccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283773 - DNA, 8699 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctctttatttttgccccggtttgttgtcttttca

SEQ ID NO: 283774 - DNA, 8153 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgca

SEQ ID NO: 283775 - DNA, 1385 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggacgaccagaacagctcgagagtcttggaatatctcttcagtcttcggtcgtttgacgatcctccagagtaccttacac

SEQ ID NO: 283776 - DNA, 267 bp, Homo sapiens
ttcaacctgtgagccaaacatttgaccttggacgacagcaaagtttagccacagattatccttgtagagctgcaagacctcaagaaagccgggctagtcaagtgaagcagtgggagtggaaaaggagcaaagaaatctgtaactggttgtgattccatgaactttttgaaatccccttgtattggcttccttccctcttctgtcttacttctctactccctacaagtgttttctgggatcacctccaaataaactacttgcaatcta

SEQ ID NO: 283777 - DNA, 399 bp, Homo sapiens
ggcgcaggcagggaccacgcggccggcgtgggggcggcgccacccgcagcagaaagccccggcgtggaccgcgtggcgtaggaaagcgctcccctcgcccccagccgcagagggcttgggcagcatcgggcgcggccccgggagagtgcgtccgcggcgccagcggctgcagggtgacctgtttcgggcggggacactcaccagaagaacacgcgtgagcagaggctagtcaagtgaagcagtgggagtggaaaaggagcaaagaaatctgtaactggttgtgattccatgaactttttgaaatccccttgtattggcttccttccctcttctgtcttacttctctactccctacaagtgttttctgggatcacctccaaataaactacttgcaatcta

SEQ ID NO: 283778 - DNA, 963 bp, Homo sapiens
  misc_feature (32)..(32): n is a, c, g, or t
acgagggggctacttggtacaaaagtccaagnagcactagatgctaggagctgggttagagggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatgtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctg

SEQ ID NO: 283779 - DNA, 1771 bp, Homo sapiens
ctcccttttttttttaaacagcagaaacagtttattaaaatagaaatcttatgtagaacctttatgcataaaaaagattcaagctgcttcacttgaaaacaggaagcagcaccaaatccccccatactcaactccaacccttgcttgtctcaaggcacctacatagaaacccagagtgtctcagaagaacagctggagcgctacagcctgctctcttctgctgtccccactgcccccggctaggatcacctcctacaagattcctgcacagcctactgacttttctccctgctcaccctcttccatccctctaacccagctcctagcatctagtgcttcttggacttttgtaccaagtaggccccaacagtaaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatggtaagtaatttaaaatattaaatttatattaaataggtaatatggtgttaaaatgcaacacctacgtgaatttgtaaggcaaaacagtacttcaaagaaatgtatatgcagtgagacatttctagctttatttccagatccctttcaacccaggtaccatttaatctctgtaattaggtgtactctggtggaacactcaccattttttagatgaggaaacagggtcagaaaggtcaagtgacctatccaaggtcacacaactagcaagcagttaagctagacttttactgtaggcagtctgcctccagtcccgctcctaaccactgtactgtattatctcctcaaatgcattagaatcttcacttccataaagaaatatgctctttgtttttttcttttggaacacaaggtttagtccatcactcactcacttttccacttttgataagatgtaaatattgagaactatttctcttctccagtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctg

SEQ ID NO: 283780 - DNA, 1289 bp, Homo sapiens
ctcccttttttttttaaacagcagaaacagtttattaaaatagaaatcttatgtagaacctttatgcataaaaaagattcaagctgcttcacttgaaaacaggaagcagcaccaaatccccccatactcaactccaacccttgcttgtctcaaggcacctacatagaaacccagagtgtctcagaagaacagctggagcgctacagcctgctctcttctgctgtccccactgcccccggctaggatcacctcctacaagattcctgcacagcctactgacttttctccctgctcaccctcttccatccctctaacccagctcctagcatctagtgcttcttggacttttgtaccaagtaggccccaacagtaaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatgtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctg

SEQ ID NO: 283781 - DNA, 1040 bp, Homo sapiens
gtaaactgaaaagcgctttgcagtctaagatagtccattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcaggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283782 - DNA, 1092 bp, Homo sapiens
gtaaactgaaaagcgctttgcagtctaagatagtccattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcaggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaaaaaagacaaaaaaaaattctccagggctggatcgggccataaggggctgaac

SEQ ID NO: 283783 - DNA, 1155 bp, Homo sapiens
gtaaactgaaaagcgctttgcagtctaagatagtccattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcaggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactggtgagcggccccggctggaggacccgcaccctggtcccgcgggccggacggaggtgggtccacgggaggccccacccccgaatccccagcccagccccatctcttgactccccagtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283784 - DNA, 1119 bp, Homo sapiens
gtaaactgaaaagcgctttgcagtctaagatagtccattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcaggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatgtgagtatttacagcgttgggaggacctcttggtcaccctaccccaacagtgcatcatcctgtcattccactcctctagctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283785 - DNA, 1234 bp, Homo sapiens
gtaaactgaaaagcgctttgcagtctaagatagtccattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcaggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactggtgagcggccccggctggaggacccgcaccctggtcccgcgggccggacggaggtgggtccacgggaggccccacccccgaatccccagcccagccccatctcttgactccccagtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatgtgagtatttacagcgttgggaggacctcttggtcaccctaccccaacagtgcatcatcctgtcattccactcctctagctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283786 - DNA, 462 bp, Homo sapiens
cggagggcgttgatggcccggaggcgttgaatggccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283787 - DNA, 251 bp, Homo sapiens
ggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaaatgctaactagtgtgtgttttta

SEQ ID NO: 283788 - DNA, 851 bp, Homo sapiens
cggggagccggggcagacgtccgtagcgccccctcccgaggaggtcgagccgggcagtggggtccgcatcgtggtggagtactggtgagcggccccggctggaggacccgcaccctggtcccgcgggccggacggaggtgggtccacgggaggccccacccccgaatccccagcccagccccatctcttgactccccagtgaaccctgcggcttcgaggcgacctacctggagctggccagtgctgtgaaggagcagtatccgggcatcgagatcgagtcgcgcctcgggggcacaggtgaggctcgcagaacacctgctgggtcagtctgtgctctgaatcccagctctcccgctttctagttctgacattggctgctttatgtaaagtgcccgcagtgcctggcacatggtaaaatgtccggccaacatgagttcccttccataggtcagggggtgtcacagaggcctgtggggaaaaacctattagactgcaatcgtgtagggttggaggggagggagtcctttattgagtgttgcgaggggcacacaggcgaggcctccctcaggttccctggagttgacccagggttggggaattgcttaaggagctacaaatgggtctccagtgggattgatgggggacttgaaggcgggggacccctttggaggaactcctgacttctgcctatgttctcagtgtaccatttatctgttgatttcttaccaggtgcctttgagatagagataaatggacagctggtgttctccaagctggagaatgggggctttccctatgagaaagatgtgagtatttacagcgttgggaggacctcttggtcaccctacccc

SEQ ID NO: 283789 - DNA, 1250 bp, Homo sapiens
gtaaactgaaaagcgctttgcagtctaagatagtccattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcaggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaaaaaaaaaaaaaagcaagcaaaaaaacacccaaaagaaacacacaacaggggggcggggcaaaaatcccgggggggcccattagcccccgttttggaaagggcccaagaaggggaaaacgagggggcggggaaccacggggggggacgcccgcgggtcggggggccctcgggggggcgggaccccggaggccggaaaaacaggtgtgcacc

SEQ ID NO: 283790 - DNA, 769 bp, Homo sapiens
  misc_feature (43)..(43): n is a, c, g, or t
tgggtaattggattctcacccctccgccctacgcactgcactncgactcttagagatccccggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283791 - DNA, 685 bp, Homo sapiens
  misc_feature (9)..(9): n is a, c, g, or t
gggcgtacnctatcgtcgacccagcgcgctccgggggtccgcagtcggcggtggagtctgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 283792 - DNA, 3135 bp, Homo sapiens
  misc_feature (315)..(315): n is a, c, g, or t
  misc_feature (967)..(967): n is a, c, g, or t
cgggtgccatgcagctttctctaatttgctctcagttcctggctatgaattgctaaactatcagtctcgcgctcaccgcccggctgaggaggtgaaagtttctccccaggaagataaaccgcaaaagacatatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggaggaagnaaggaggggcgcgctgcgcgaggcggagagagggcgaagcagtcgcggcactggcgctcacattcctctatgctacaaatccaggaggaagtttttttttagggggctgagatgctccatgcctttaaaagggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgccgcgcggcgcgcgcgcgccattgcctgcaggctaggacttcgcgaggtgggtcgactcaccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacngccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctc

SEQ ID NO: 283793 - DNA, 1041 bp, Homo sapiens
tgcactgcgccctgggtgggtgggtgaatgtgaagaggcggcgttgggctaggcccctgcagcccgctcggagcgtcctaggcccggggctgcgctgtgaaagacccagattctcatcccagaggcccagcagtcctgaaaggcctcctctccgaccctgagccgggtccgccgaacaaagttcggaagctcgggctagctgggccagcgccattttctcgcacttgtggctggatctggttgtcccggcgactgcgccccggcgcggtctcttttcctctacctcggatccccagcactgactcgccctcagacgccggggaaggtgtggtgagctcccggccccggccgaggggtccctggagaggagctgggtggcggtggccaggccgagcgcggttgctggcccgcgcctccctccccgaggcaccattgttccgggatcgctgtgaccgccacaaagtgaatcctttcggtgcggacagtcgccttcaaagccaggccccggattcaggtcagggagaatctcagctcctgagaaatttgctcctgtttgccgcttctgctactcgaggaaatgaaacgccattaatatttgaaaaggcaattattttcctgttgaatcgagaactgtcttcatgaataatttgtagtgaggtctattgccatttgagaaatattttttttccctctctctctctctctctctctctcactctctctctcttctttttatgactaggagggggatttgagggaaatgcccgagcaggccagactctgtagttcgttgttggtcgtgtttgtttgtttgtttgtttttgtttgttgtttcccccaccccccaccgctaatgaatcaggaccgcgaaccgaaagaacgcacaaaattctgtcctgaaaacacgaaaacctgagccagccgtggcgcactgaacttgcttctctgctgtaggtcgactgtgctaagaatttaaccattttctgcttcacagaattcaaacagtgggccggcaaagagctgtaaaagtttgtttgttta

SEQ ID NO: 283794 - DNA, 2987 bp, Homo sapiens
  misc_feature (93)..(93): n is a, c, g, or t
  misc_feature (448)..(448): n is a, c, g, or t
agggggctgagatgctccatgcctttccccgggcagccttgacgcgcggccctctcggcagagactgagcggcgaggggctagtggaggaagnaaggaggggcgcgctgcgcgaggcggagagagggcgaagcagtcgcggcactggcgctcacattcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacngccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctccgtgattgtggtaggaatttcttcttcacccaccagcaacctgctgcctcttctgccagtcttaaagggtctccagaaaagctctccagtctcccttgccttccctttctgtcactgcaggtcgtataaacgtgataaatgaatgctaccctgctggctctccgagagagtgtaattagtatttatatcaaaatttatgaaacaaattttcggccgcagtataatttaaatgacctttgcagatgtagaataacaaccataaaaataacaggaatagattgcacaggcgacatcaatattaatgtagacgaattgtcagaagctcaggggctcgctctgcaacattgcaaatgaacttgcagccgagggtt

SEQ ID NO: 283795 - DNA, 1236 bp, Homo sapiens
tcgcgtgtgcttgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctc

SEQ ID NO: 283796 - DNA, 2616 bp, Homo sapiens
  misc_feature (93)..(93): n is a, c, g, or t
  misc_feature (448)..(448): n is a, c, g, or t
agggggctgagatgctccatgcctttccccgggcagccttgacgcgcggccctctcggcagagactgagcggcgaggggctagtggaggaagnaaggaggggcgcgctgcgcgaggcggagagagggcgaagcagtcgcggcactggcgctcacattcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacngccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctc

SEQ ID NO: 283797 - DNA, 1886 bp, Homo sapiens
tgcactgcgccctgggtgggtgggtgaatgtgaagaggcggcgttgggctaggcccctgcagcccgctcggagcgtcctaggcccggggctgcgctgtgaaagacccagattctcatcccagaggcccagcagtcctgaaaggcctcctctccgaccctgagccgggtccgccgaacaaagttcggaagctcgggctagctgggccagcgccattttctcgcacttgtggctggatctggttgtcccggcgactgcgccccggcgcggtctcttttcctctacctcggatccccagcactgactcgccctcagacgccggggaaggtgtggtgagctcccggccccggccgaggggtccctggagaggagctgggtggcggtggccaggccgagcgcggttgctggcccgcgcctccctccccgaggcaccattgttccgggatcgctgtgaccgccacaaagtgaatcctttcggtgcggacagtcgccttcaaagccaggccccggattcaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctc

SEQ ID NO: 283798 - DNA, 632 bp, Homo sapiens
ggaataaataggtaaaagaatgttcatatgttaagagttaataccatcaatagaaagtggactagtaagcgtacaggacaataggtgaaccaatttattaaataataagaaaaggaataattaaaataagtaagaaataaatagagatagagaaaaaaagaagagagagagagagagagagagagagagagagagagagctcgtgccgaattcggcacgagcccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283799 - DNA, 829 bp, Homo sapiens
taggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctatggagtcttgctccatagcccag

SEQ ID NO: 283800 - DNA, 2406 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccagatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283801 - DNA, 2343 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccagatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283802 - DNA, 2544 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatgatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283803 - DNA, 2461 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatgatgtgaacatggaatcatcaaggaatgcacactcaccagcaacaccaagtgcaaagaggaaggatccagatctaacttggggtggctttgtcttcttcttttgccaattccactaattgtttggggaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283804 - DNA, 2250 bp, Homo sapiens
taggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccagatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283805 - DNA, 2653 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283806 - DNA, 2590 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283807 - DNA, 1908 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactatta

SEQ ID NO: 283808 - DNA, 2481 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatgatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283809 - DNA, 2628 bp, Homo sapiens
agccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283810 - DNA, 2514 bp, Homo sapiens
acgcgggcacctgggagcggcgggctgctgcgggaggcgttggagactggctcccgggggctgttaggaccttccctcaggcccgggtgctcagaacgctggaggacttgcttttcttgggccttgatgcgaagtgctgaccccgctgggcaggcggggcagctccggcgctcctcggagaccactgcgctccacgttgaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 283811 - DNA, 902 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagc

SEQ ID NO: 283812 - DNA, 596 bp, Homo sapiens
ttaatacccaatgaaaaaagttgaggtgtcttagacagattccaattgtatggtcgaaagctttgaacaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagc

SEQ ID NO: 283813 - DNA, 1562 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaa

SEQ ID NO: 283814 - DNA, 1565 bp, Homo sapiens
tattggctaggtgggcggtgtgaatcggccgagggagcgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaa

SEQ ID NO: 283815 - DNA, 1268 bp, Homo sapiens
ttaggctaggtacgaggcctggggtgtgagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaa

SEQ ID NO: 283816 - DNA, 1503 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaatccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaa

SEQ ID NO: 283817 - DNA, 843 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaatccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagc

SEQ ID NO: 283818 - DNA, 1179 bp, Homo sapiens
taagtcttttttattgatgacaaaatgccaggcacaacccgatggggccaagtcaccatcatttgatctgggtgaacactttctcaagggaccaggatcctccctgccgaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaa

SEQ ID NO: 283819 - DNA, 859 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagc

SEQ ID NO: 283820 - DNA, 629 bp, Homo sapiens
gttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcatacaataaaatttaccattttgaagtgtataatcagaaccgggtatggtggcttatgcctgtaatcccagcaaatggggaggctgaggtggagaatcgcttgaggcaggagttcaagaccagcctgggcaacatagtgagaccttagactctaaaaataaacataaataaaatttataatccgttggtttttagcttattaacaaggttatgtaactgtcaccactgtggaggaagcagtgatgataaagggaactcctataccctttagcagtcactctctattctttcctcctcatccccttgcagtcac

SEQ ID NO: 283821 - DNA, 869 bp, Homo sapiens
tattggctaggtgggcggtgtgaatcggccgagggagcgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttcgtaacatgattatgattgtttagggggccaacgggtttaacttaatggagaaatattgcaaggggttttggtttcgaaaggggtttataagtcaaaaaaaaaatggggggcaataaaggggagaaggtgacgaagggcaaaggaagtg

SEQ ID NO: 283822 - DNA, 1508 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaa

SEQ ID NO: 283823 - DNA, 857 bp, Homo sapiens
agcggaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgtagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagc

SEQ ID NO: 283824 - DNA, 283 bp, Homo sapiens
cccaccctcaccaaggtgagcaagtagcatttttcatattgtatgtttccttttcttctatacattgaaaaactgctttaaatagcaccaggtttcgtaaatgaccaggcacttgggacattttcattattaaaacctgttcttggtcactttctgctgaagaactggaatgaggctgtaagctttactgtcatggaacctgggagcagggcctacagcacagctgctgcctctgggctccggtgccaactttgaaagctcctccactggtcgtgacgtgggg

SEQ ID NO: 283825 - DNA, 368 bp, Homo sapiens
  misc_feature (166)..(166): n is a, c, g, or t
  misc_feature (322)..(322): n is a, c, g, or t
  misc_feature (339)..(339): n is a, c, g, or t
  misc_feature (356)..(356): n is a, c, g, or t
aattctaaagaattgaagaagttatatcccttaagatagttgtcccttgcatttttattacattgaggccaatttcttattcagaatgtcagtaagtacaaaatacagaatttttacttttgaaggtaagattatctttcggccgggattacaggcgtgacactgncgcccagcctaaattggtattataagtaaaaatatatcccattgcaaaacaagtctacaaatgatgggaaattaattagtatttacccaaccatttaggcatatacataaccggtattactttaccaaattgtcttcattaaacccccaaaggggnaccaatatggatacccncacctatctgttagggnttaaacttgggg

SEQ ID NO: 283826 - DNA, 476 bp, Homo sapiens
gtgaagacagggagctcaagtgacctcctccagggtatatagctgtggtgtgggaagcatcatgagaacacggtctttgatggggataattactctgaatctaccaggctgattaagccacagcagatcagcaggtgagaattcaactgtccagatagaaaggtggacatggaaaaattgggctttgcaaatggtcacccaattcttgccttcctggtctccagatcacccttcctataccgccactctggagaaagaagtacagaacgctaacaaggatggcttggagttgcagtggtcacctcagatcttaaggtcactttggagatggaacccctgtgactaggaatggcagaagagaaaggtagaaagagattgagtcctggggatgtggcagagccaccatcctagccccgtactgcgtacttctggacttcctttaaattgagagaaacatgttcctaccatatttaaaa

SEQ ID NO: 283827 - DNA, 1908 bp, Homo sapiens
ggccttgcctgtcactttttccagaggcgagggtcgcggaggggacagcgtcagggccgctggggtgtggacggcgggcgaggcgcaaactttactaggagtttttggcacttggaggcagagcctgttgggcggcacagcacgcccgctgggaaacgcaggggagcggcctgcttcgctgaaaacccgaccaggacctaacgggccgcgggacagaaacctccgagaccatggtacacagcaactaccgcaactcgctcctcagcccctgactcttcgtccccgccccacagagcagtataagtagggcccgaaacagaactggcaaccgcagtagccaatctacttgccaacatcactttgacagcccaatcacgatgaagaggaggcggggagaccgtgagtaatgccccccggactcttactactagaaacccaagtcctccgggaggcggaaggaaggggagggccgggcacgggcggaagtggcggcgcatgcgcactggcaccctctcggtgtcctttgagctgcggccgcagagtgcgcgggagacctacccattccgcggccggaccaccactcccagcagcctaggcggctcccgcgcctgcgccatccgtcaccgccctccctttgtgtcgtctcccggtactcagtttggaacggcttggagacaaaggggcctgagagggaagctgcttcctagtgccgagccccagaagaggtggataggcccgaggggcgccttccctaggccttatctcttcccgccctgtgtcatggacaccgttctcggaggccgctccccacacttggaaaggccgcccacagtatgcagacacccggtcggcggcgtcctgaggccattcagctcccggaaccgccctcccccgcgtcgcccctctaccctcccaaagctcccggattttgggctttctgagaagcctggacgccacgcgagcccgttgcctaggcgaccggccccgcgcgccggcccccccccttccggccaaagggcccgcccctcctgggcgtggcctcgtgcctttgtgcacttcccgcctggctctctggttccggggcggcctcggcttcggcctccgccccgctgcggccgccgcgggtcccctccggggtggccccgagagctgtgttcgccacgcttggctgcctgcttttctctgattttcttccgccttggaccctgctctatttgcattgtctttttttcagcaagtcggagaacggtgccttgtcagttttcacctttctcactggactttctcttttccggagagccgggttggtggtgctgcctgtgtattccacgaactaagccctgtccccagcccttgcagtgtttctgtatcaactccacgccagcgcggttctccatttttcttagcctcttaattaggacagggtcggatttcagcttttatccaccgggtttatcctgttgcaaagcagagtacacagttttagacacaaaataattgcagttgaaatggatacacattctggtggtaagatttggaaacgtggtatttgatggaaccctgttgtaacatctaaaactctttggattttttaaaaacgtattctgtgtaatccagtaaaaatttggattcgtccagtatttatagagtagattattaaccgcagtggtgctcattccagggccctgccgggtattttgtgctatggatgtgagtacggcaaagagactgaattaagctgttttgtatttggaatcggattgttcacgttgcaacgttgctgcaatgataaatggatggatactctttacactttgaagtggatttaatcttcacttttaagccccttcatctcacctacacagcaggagagctttggctttgatatttggggaaatggctgttatt

SEQ ID NO: 283828 - DNA, 906 bp, Homo sapiens
tcttggagataagccttgtaaaaagctacaggccagggagaatttcagggtcagattcaggagttccttaaatgagtttggttttcctcctgtctttcacatacataggggatgaaataatacccaggtcatcaaagtctgtgaaaccaactgcaacaggacctctgattcttcccactcagagacccacaagtgccactctgtttttggacaacggtcaacaagcttcaccgccaagtgcctgatttgtcaaatgagagctttgtcgtttcttcagatgctgaccagtatctgaattcagtatctctgaattacaggagaggagaaaatagatgaaatactgctgtcagtaccacggttgctggctcttgtttagcttctgagtcagctggggcacccctgccatctgctctcagtgtggggctgggtgtccctgcaccgtggaacaagggcaggtcctgtcttcccggaaggcccagcacgggtgaagatttgggggcagatttataccaacatacactggtctatacattggatatgtgcaggttcccattcgtttcctggggagccatgtgtccctgaggccagagagtctcctcacccagctcagactgaatgcttttgtttttgtttcagggcatttgcacgccaaaggcaaagaagaaaaaatgtccaaatcattaaagaactacattactattaaggtaacgtgctttttgtattgtatctctgaggtgccgatagcttgtggaacccatcttaaaggcttctgtgtcatttgagaaccacggaatcccattcccagtgccctctggcccctttcttatgacgagacctgcctcacctccctcccactttaagtggctctccgcctaatcgcgccctcagctgtgcgcctcccgcagg

SEQ ID NO: 283829 - DNA, 1186 bp, Homo sapiens
cttcatgaaagtaaatagatgaggctgattgccccgaagtcacttcctcgttgacttcgttcagggctcagttcagcgctccctgaactgtctgaggagctggagttgctccctccgcaggcacgtttctgtctgcaggtttatcctgttcagtaggtcagggtttgttactgacaaccatgacctgctgtgagcccttctgcgagtgtggagctggggggcaagaagggcagccttagctgtgccaacgcttcgtcctgtcagggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggtaagaggcccgcctagcacccggcgtggcacccctcctgtggcctgctgggtgctgctggtgggctcttgaaggggaagaggggcccccaggagacagggcgctggacaggaggttctggggtcagggactgcccagagaggccccaggagacagggtgctgggcaggaggtgcaggtgtggggtcaggggctccccagaggccacaggacactgggtgctggacaggaggtgtggggtcaggggctcccgagacatcccagggagacggcgctggcaggaagtgtgcctggggccctcgggctctgagccccctgctcagagtggctttgggctcgggttccctgtgcgaggagcggagctgctcatccctcccagtcctgactgtgaggagccaaaatctataaaacacacaggcctgggcccacagcatcgcctccactccccacccacgggtgtcctgggcagcgctgcacattcatcccggcatgcagagtcttccggatggtcttggtgataacccacccctgccacttcagcagggtaggcagccagtggccacgggaggctgagatccgggagccccgggctgggcctccccagcctctctttgtgagtggtcagccgtgccgtctctcccccaccgag

SEQ ID NO: 283830 - DNA, 1173 bp, Homo sapiens
cttcatgaaagtaaatagatgaggctgattgccccgaagtcacttcctcgttgacttcgttcagggctcagttcagcgctccctgaactgtctgaggagctggagttgctccctccgcaggcacgtttctgtctgcaggtttatcctgttcagtaggtcagggtttgttactgacaaccatgacctgctgtgagcccttctgcgagtgtggagctggggggcaagaagggcagccttagctgtgccaacgcttcgtcctgtcagggcatttgcacgccaaaggcaaagaagaaaaaatgtccaaatcattaaagaactacattactattaagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggtaagaggcccgcctagcacccggcgtggcacccctcctgtggcctgctgggtgctgctggtgggctcttgaaggggaagaggggcccccaggagacagggcgctggacaggaggttctggggtcagggactgcccagagaggccccaggagacagggtgctgggcaggaggtgcaggtgtggggtcaggggctccccagaggccacaggggactgggagctggacaggaggtgtggggtcaggggctccccagaggccacaggacactgggtgctggacaggaggtgtggggtcaggggctcccgagacatcccagggagacggcgctggcaggaagtgtgcctggggccctcgggctctgagccccctgctcagagtggctttgggctcgggttccctgtgcgaggagcggagctgctcatccctcccagtcctgactgtgaggagccaaaatctataaaacacacaggcctgggcccacagcatcgcctccactccccacccacgggtgtcctgggcagcgctgcacattcatcccggcatgcagagtcttccggatggtcttggtgataacccacccctgccacttcagcagggtaggcagccagtggccacgggaggctgagatccgggagccccgggctgggcctccccagcctctctttgtgagtggtcagccgtgccgtctctcccccaccgag

SEQ ID NO: 283831 - DNA, 788 bp, Homo sapiens
ctcattttcatcaaggttcctgatttcttgataggtagagataacttatgtaattgtagaaagtaacatattctctgaacagtgcgaagcgtaaaagcaaagcctcgtgactgcctgtctctcgctttaccaggactttctgaagaccttttcccccgatgtcttccggttcttctgcctgcggagcagctaccgctcaggtgagccgagcacacgtggagtggactccccccccagctcggagacagtcattctgacaggactgaaaacagcaaaatgcaggccagagaataagcagaaccttgttgagtgaggctgctgtgtgccttacggttcgggttgagagtgaacccagaggacgagggatcccagtgctggtctgggcccggcccacagtggatgtgggcttcctcgtcaagctcgagtcctctccactccttctctctgggtctggacaagtcgtgaacccgcagcacctcggcttcctgctgtgtgaactgggagattggaaggggccagcctggcacggcccctgaacatgggagccctcaaacgtgaccctgcctgtcctgcccaggggcagcacttccccgaacggtgtgtagcagagcaaggtctcctggatgggtgatgacggttcctcccatgctgcacagttacctgctgccccgggctaggctcttggccaggagttgtctagcactggcctggcatggtggctcacgtgtatgatcccagcactttgggaggccgaggctggcagatgttttgagtccaggagtttgaga

SEQ ID NO: 283832 - DNA, 454 bp, Homo sapiens
  misc_feature (435)..(435): n is a, c, g, or t
tcttggagataagccttgtaaaaagctacaggccagggagaatttcagggtcagattcaggagttccttaaatgagtttggttttcctcctgtctttcacatacataggggatgaaataatacccaggtcatcaaagtctgtgaaaccaactgcaacaggacctctgattcttcccactcagagacccacaagtgccactctgtttttggacaacggtcaacaagcttcaccgccaagtgcctgatttgtcaaatgagagctttgtcgtttcttcagatgctgaccagtatctgaattcagtatctctgaattacaggagaggagaaaatagatgaaatactgctgtcagtaccacggttgctggctcttgtttagcttctgagtcagctggggaagggttcgggggttctttcccccgggaaggggccccaggnaacgggggtggaaaggatt

SEQ ID NO: 283833 - DNA, 2301 bp, Homo sapiens
ggccttgcctgtcactttttccagaggcgagggtcgcggaggggacagcgtcagggccgctggggtgtggacggcgggcgaggcgcaaactttactaggagtttttggcacttggaggcagagcctgttgggcggcacagcacgcccgctgggaaacgcaggggagcggcctgcttcgctgaaaacccgaccaggacctaacgggccgcgggacagaaacctccgagaccatggtacacagcaactaccgcaactcgctcctcagcccctgactcttcgtccccgccccacagagcagtataagtagggcccgaaacagaactggcaaccgcagtagccaatctacttgccaacatcactttgacagcccaatcacgatgaagaggaggcggggagaccgcggagtctccctctgttgcccaggctgcagtgcagtggtgtgacctcagctcactgtgagctctgcctcctgggttcaagcgattctcttgtctcagcctccccagtagctgggactacagatgcacgccaccacgcccggctaatttgtgtatttttagtagagacggggtttcaccatattggtcaggctggtctcgaactcctgacctcaggtgatccatccgcctcagcctcccaaagtgctgggattacaggtgtgagccactgcgcctggcccaatagaggcacgtttgtcaagctattgtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283834 - DNA, 1944 bp, Homo sapiens
ggccttgcctgtcactttttccagaggcgagggtcgcggaggggacagcgtcagggccgctggggtgtggacggcgggcgaggcgcaaactttactaggagtttttggcacttggaggcagagcctgttgggcggcacagcacgcccgctgggaaacgcaggggagcggcctgcttcgctgaaaacccgaccaggacctaacgggccgcgggacagaaacctccgagaccatggtacacagcaactaccgcaactcgctcctcagcccctgactcttcgtccccgccccacagagcagtataagtagggcccgaaacagaactggcaaccgcagtagccaatctacttgccaacatcactttgacagcccaatcacgatgaagaggaggcggggagaccctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283835 - DNA, 1745 bp, Homo sapiens
aaacgctcctcccgcgcggcggacacagctccaggctggtaccgcgcgcacacggacgcctcgcaggacctgggctaataaggagaggagatcggcacggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgaggcatgagtcaaaggaatggtgtgaggtccttgaggaacattttcactgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283836 - DNA, 1987 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacatacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283837 - DNA, 1794 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283838 - DNA, 1537 bp, Homo sapiens
tcttggagataagccttgtaaaaagctacaggccagggagaatttcagggtcagattcaggagttccttaaatgagtttggttttcctcctgtctttcacatacataggggatgaaataatacccaggtcatcaaagtctgtgaaaccaactgcaacaggacctctgattcttcccactcagagacccacaagtgccactctgtttttggacaacggtcaacaagcttcaccgccaagtgcctgatttgtcaaatgagagctttgtcgtttcttcagatgctgaccagtatctgaattcagtatctctgaattacaggagaggagaaaatagatgaaatactgctgtcagtaccacggttgctggctcttgtttagcttctgagtcagctggggcacccctgccatctgctctcagtgtggggctgggtgtccctgcaccgtggaacaagggcaggtcctgtcttcccggaaggcccagcacgggtgaagatttgggggcagatttataccaacatacactggtctatacattggatatgtgcaggttcccattcgtttcctggggagccatgtgtccctgaggccagagagtctcctcacccagctcagactgaatgcttttgtttttgtttcagggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283839 - DNA, 1243 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctgggctgctaggtcagcattaaagtaaggcaaccaacagtg

SEQ ID NO: 283840 - DNA, 2498 bp, Homo sapiens
gactttttcttggggtaacatgacagtttgcagttgatgttacataattttctgctactcaggaactcaagtctttgggaatatgacctagagaaagtccccagattagagcccccagcgtctctccctggggaaggactggtgtgggggccgcctggggagagtggagctccctctgctgtgactgttctctcctcttccctcaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacaacagtaagagaacattttttcctgacccatttgagggcaagttggcgacctgagcccccttgcctggcacatgttttgtacggacaggacgggctccccgacaggcacgagtcacctgcaccttcccagcgaggctcaccctggctgtgcagtgaaggtggacgctgccaggcttctccacattccttctcttccgttgtaactcaagagcatttttgcaaagagacttggatcctatgaaaatgtcctcttccttatcaggctcacctgaaactcgtttattctatcaatacagatttgaggtttcctgccttattcttaaagtccccaccatcactttgtatgtggctgacagaggccccttggggctggcgctgtgtccctgaacatccctgtcattctttggacacccttgtagaattctcagcacaaggcgctctggctcttttggggtgtggctcggctgctgctgcctggacgggggctgccactctagaccagctgcccagcaccccgagggtcccgccgcttgggactggggcccaagcaggtgtgctgaaggcctggctctgggccaaacatgtctcgctggctctcaacagagaactatagtgtcttttccaagtttggctcatttgtatacctgttgatcacctggtagacttagttcccctttccagcagtccggcgtctgttgccaatcacataaaagtcgactggtgtgagatgacccaagtttttgcaatgtacatgttcatttttaggggtggctttccggagtctgttttgagtaagaaaagtgggatctggccaagctctgcctagcccttgtcaaagatatctcattcaccttcctctggccgcaaggcccaatgtctgggcccactctgggctcatatttctgtaataacaaaaactgtcttttatcatggaagcaataactgaggggtgtgtgaggtttaagtagtttgacaccaaggtcaaatgttgtgtctgtttcttattttacacacatggatttaacaaataggtacagctgccccttccacaccgccccaggatctgttctcagtgggaggacagcgcgaggccttctgcgcaaatcccgtcctcagcacctgaggctgtgaatctcagaccatttgccgaaacacacgtgtgcaagcgctcagtcgctgccccccagcctcatcctcaggttgctcctgatacctcggccacaattgcgtgaggtctggaagccagggagcgtttgtgttcagggcggggcggcatgcagcccccagccctttcttccaactcccgagtgaggatcactcagccttgcttggacgacagatgctcagagttgagtggagccttgcccagagcccagcgctcgcgggctgtacccatccctgccagacccagaaagaggcccagctgcagggaatcagggaagcccagggctgggtgggtgtcggcccagagcccaaccacggggtggggaggggggcatccacaatccacagtctccgggggacgtaaccgcgccctgctggcttcagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283841 - DNA, 951 bp, Homo sapiens
gactttttcttggggtaacatgacagtttgcagttgatgttacataattttctgctactcaggaactcaagtctttgggaatatgacctagagaaagtccccagattagagcccccagcgtctctccctggggaaggactggtgtgggggccgcctggggagagtggagctccctctgctgtgactgttctctcctcttccctcaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacatacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283842 - DNA, 430 bp, Homo sapiens
  misc_feature (145)..(147): n is a, c, g, or t
  misc_feature (149)..(149): n is a, c, g, or t
  misc_feature (151)..(151): n is a, c, g, or t
  misc_feature (153)..(154): n is a, c, g, or t
  misc_feature (156)..(157): n is a, c, g, or t
  misc_feature (166)..(167): n is a, c, g, or t
  misc_feature (173)..(173): n is a, c, g, or t
  misc_feature (176)..(177): n is a, c, g, or t
  misc_feature (182)..(188): n is a, c, g, or t
  misc_feature (191)..(195): n is a, c, g, or t
  misc_feature (205)..(205): n is a, c, g, or t
  misc_feature (210)..(212): n is a, c, g, or t
  misc_feature (214)..(215): n is a, c, g, or t
  misc_feature (240)..(240): n is a, c, g, or t
  misc_feature (243)..(243): n is a, c, g, or t
  misc_feature (247)..(248): n is a, c, g, or t
  misc_feature (251)..(252): n is a, c, g, or t
  misc_feature (254)..(254): n is a, c, g, or t
  misc_feature (257)..(257): n is a, c, g, or t
  misc_feature (269)..(269): n is a, c, g, or t
  misc_feature (277)..(278): n is a, c, g, or t
  misc_feature (280)..(280): n is a, c, g, or t
  misc_feature (289)..(290): n is a, c, g, or t
  misc_feature (293)..(293): n is a, c, g, or t
  misc_feature (296)..(297): n is a, c, g, or t
  misc_feature (302)..(302): n is a, c, g, or t
  misc_feature (305)..(305): n is a, c, g, or t
  misc_feature (307)..(309): n is a, c, g, or t
  misc_feature (312)..(314): n is a, c, g, or t
  misc_feature (325)..(325): n is a, c, g, or t
  misc_feature (334)..(334): n is a, c, g, or t
  misc_feature (343)..(344): n is a, c, g, or t
  misc_feature (346)..(346): n is a, c, g, or t
  misc_feature (355)..(359): n is a, c, g, or t
  misc_feature (370)..(370): n is a, c, g, or t
  misc_feature (378)..(378): n is a, c, g, or t
ggctgtaccggcccgaaggtcctttgatgacatgttgaggactacgcgcggcccaggcctgggccccccgctgctccaggccgcgctgggccttgggcgggctgggtggcactggcctgcgggccgggcggcgagcggggggctnnncncncnntnnatcatacannaacccnacnnataannnnnnnaannnnnaaaaaacaanaaaannnannaaccaaaaaattatactccacaaanaanaaannacnntnatngtatatatgtgnaaaaaatnnantttcataannacnaanntgctnaancnnncannntatctttcatnttttttaantacaaccannanataaaaccnnnnnccttcaacaanactaatcntcatccctattaaacatctacttcatataataataaaaactcaaatttctac

SEQ ID NO: 283843 - DNA, 567 bp, Homo sapiens
ctctctttgtgagtggtcagccgtgccgtctctcccccaccgagtcttccttgccactcccctcaatatctattgatttttaaaaccatcatgaaaatgcccacgtgtgtcttgtattttaagtgtcacaggtgacctctgctctgggactttttcttggggtaacatgacagtttgcagttgatgttacataattttctgctactcaggaactcaagtctttgggaatatgacctagagaaagtccccagattagagcccccagcgtctctccctggggaaggactggtgtgggggccgcctggggagagtggagctccctctgctgtgactgttctctcctcttccctcaggctctccagcaccaagagggccgtgaaggcggccttggcagatgattttgacacacccagggtggttgatgccatcctgggccttgcacaccacgggaatggacagctcagggcgtccctgaaggtagctcaacgaacaggtggccttgcggtcctgctgccaggggcatgggtcgggtcctctggtgggtttttctcatgtcggctgggtggc

SEQ ID NO: 283844 - DNA, 440 bp, Homo sapiens
cccaaagtgctaggattacaggtgtgagccaccacgcctggcctggatttctttttttgaaaaaaaaatatacatatacatactttttaagtcagtgagatttgaattatagcatttgtctgtcattgtggcttcccttcctctttaacctcccgtcacacccatgcatcttccttttgtgaaatggggtggaactagtgactaaagatttggattggaagtcagaggccgcctttgggctggggcgtttatctgaaaagaggctgaactttgtcatttgttgagtgaacagagctcttctcttgtctcttaggcatgagtcaaaggaatggtgtgaggtccttgaggaacattttcactgaggtctctgtcttcctattttctattgatttgtctttctcataactgggtagtctcccaccgcatggggctgtttagca

SEQ ID NO: 283845 - DNA, 833 bp, Homo sapiens
gactttttcttggggtaacatgacagtttgcagttgatgttacataattttctgctactcaggaactcaagtctttgggaatatgacctagagaaagtccccagattagagcccccagcgtctctccctggggaaggactggtgtgggggccgcctggggagagtggagctccctctgctgtgactgttctctcctcttccctcaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283846 - DNA, 1869 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283847 - DNA, 938 bp, Homo sapiens
ggctgtaccggcccgaaggtcctttgatgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacgaagcgtcaatgccagtgacgtatctgcccttgtggcaagtgcggccaaaatacacccaaggaaggggtgatacctggtagcccctcatccccatagcggaaaccccgcgtgaagcgcctggggatggtaacacctgaaagtgtccagagcgaaaccgcatagacatgggacaattgtgtagaggatacgggtgtggaatactccgttccgtggtgcagaataggacttgacggtatacga

SEQ ID NO: 283848 - DNA, 798 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcaccctctacatcaccgccccgaccttagttctcaccatcgtctttctacatatgaacccccgtccattaccaaacccctgtcaaacctcaaactaggcctcctatttattctagccacctctagacctagcccgttaactcaatcctctgatcggggtagagccatcaaatataccgaactaacgcctgaatcggcggcaattgcgaaccaggatggcccaaacgaatgttcaatattgaagggcacgcagaaacaatcaggtctactattaaaaatagtgtactaagtggacattaaaccgcgtcaaccttataccaacactaaggagacgcctctgattaactttgccaatatgaagccaggacaaaatatagaatacaccaacacaagcgaaaaaacagagcccttgaatgacatgagaaccaaacagaaaggcgga

SEQ ID NO: 283849 - DNA, 3534 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacaacagtaagagaacattttttcctgacccatttgagggcaagttggcgacctgagcccccttgcctggcacatgttttgtacggacaggacgggctccccgacaggcacgagtcacctgcaccttcccagcgaggctcaccctggctgtgcagtgaaggtggacgctgccaggcttctccacattccttctcttccgttgtaactcaagagcatttttgcaaagagacttggatcctatgaaaatgtcctcttccttatcaggctcacctgaaactcgtttattctatcaatacagatttgaggtttcctgccttattcttaaagtccccaccatcactttgtatgtggctgacagaggccccttggggctggcgctgtgtccctgaacatccctgtcattctttggacacccttgtagaattctcagcacaaggcgctctggctcttttggggtgtggctcggctgctgctgcctggacgggggctgccactctagaccagctgcccagcaccccgagggtcccgccgcttgggactggggcccaagcaggtgtgctgaaggcctggctctgggccaaacatgtctcgctggctctcaacagagaactatagtgtcttttccaagtttggctcatttgtatacctgttgatcacctggtagacttagttcccctttccagcagtccggcgtctgttgccaatcacataaaagtcgactggtgtgagatgacccaagtttttgcaatgtacatgttcatttttaggggtggctttccggagtctgttttgagtaagaaaagtgggatctggccaagctctgcctagcccttgtcaaagatatctcattcaccttcctctggccgcaaggcccaatgtctgggcccactctgggctcatatttctgtaataacaaaaactgtcttttatcatggaagcaataactgaggggtgtgtgaggtttaagtagtttgacaccaaggtcaaatgttgtgtctgtttcttattttacacacatggatttaacaaataggtacagctgccccttccacaccgccccaggatctgttctcagtgggaggacagcgcgaggccttctgcgcaaatcccgtcctcagcacctgaggctgtgaatctcagaccatttgccgaaacacacgtgtgcaagcgctcagtcgctgccccccagcctcatcctcaggttgctcctgatacctcggccacaattgcgtgaggtctggaagccagggagcgtttgtgttcagggcggggcggcatgcagcccccagccctttcttccaactcccgagtgaggatcactcagccttgcttggacgacagatgctcagagttgagtggagccttgcccagagcccagcgctcgcgggctgtacccatccctgccagacccagaaagaggcccagctgcagggaatcagggaagcccagggctgggtgggtgtcggcccagagcccaaccacggggtggggaggggggcatccacaatccacagtctccgggggacgtaaccgcgccctgctggcttcagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283850 - DNA, 1919 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgaggcatgagtcaaaggaatggtgtgaggtccttgaggaacattttcactgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283851 - DNA, 1892 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtgaaaaaaaaaaaagtcgtatcgat

SEQ ID NO: 283852 - DNA, 1754 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcggacgaccacacccatgcttctcagggtcggcttttgttgct

SEQ ID NO: 283853 - DNA, 1696 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggctaccttgcatggtgtggtggacgagctggtgcggttccggcagaaggtccggcagtttgcgctggccatgcccgaggccacgggggacgcccggcggcagcagcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283854 - DNA, 1478 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctgtcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283855 - DNA, 1944 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggtaagaggcccgcctagcacccggcgtggcacccctcctgtggcctgctgggtgctgctggtgggctcttgaaggggaagaggggcccccaggagacagggcgctggacaggaggttctggggtcagggactgcccagagaggccccaggagacagggtgctgggcaggaggtgcaggtgtggggtcaggggctccccagaggccacaggggactgggagctggacaggaggtgtggggtcaggggctccccagaggccacaggacactgggtgctggacaggaggtgtggggtcaggggctcccgagacatcccagggagacggcgctggcaggaagtgtgcctggggccctcgggctctgagccccctgctcagagtggctttgggctcgggttccctgtgcgaggagcggagctgctcatccctcccagtcctgactgtgaggagccaaaatctataaaacacacaggcctgggcccacagcatcgcctccactccccacccacgggtgtcctgggcagcgctgcacattcatcccggcatgcagagtcttccggatggtcttggtgataacccacccctgccacttcagcagggtaggcagccagtggccacgggaggctgagatccgggagccccgggctgggcctccccagcctctctttgtgagtggtcagccgtgccgtctctcccccaccgag

SEQ ID NO: 283856 - DNA, 1691 bp, Homo sapiens
cccggcgtggctcccgtctccgcccgagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcaggtgagccgagcacacgtggagtggactccccccccagctcggagacagtcattctgacaggactgaaaacagcaaaatgcaggccagagaataagcagaaccttgttgagtgaggctgctgtgtgccttacggttcgggttgagagtgaacccagaggacgagggatcccagtgctggtctgggcccggcccacagtggatgtgggcttcctcgtcaagctcgagtcctctccactccttctctctgggtctggacaagtcgtgaacccgcagcacctcggcttcctgctgtgtgaactgggagattggaaggggccagcctggcacggcccctgaacatgggagccctcaaacgtgaccctgcctgtcctgcccaggggcagcacttccccgaacggtgtgtagcagagcaaggtctcctggatgggtgatgacggttcctcccatgctgcacagttacctgctgccccgggctaggctcttggccaggagttgtctagcactggcctggcatggtggctcacgtgtatgatcccagcactttgggaggccgaggctggcagatgttttgagtccaggagtttgaga

SEQ ID NO: 283857 - DNA, 2465 bp, Homo sapiens
ggcaccgcctcagtgaccatctcttcctcctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacaacagtaagagaacattttttcctgacccatttgagggcaagttggcgacctgagcccccttgcctggcacatgttttgtacggacaggacgggctccccgacaggcacgagtcacctgcaccttcccagcgaggctcaccctggctgtgcagtgaaggtggacgctgccaggcttctccacattccttctcttccgttgtaactcaagagcatttttgcaaagagacttggatcctatgaaaatgtcctcttccttatcaggctcacctgaaactcgtttattctatcaatacagatttgaggtttcctgccttattcttaaagtccccaccatcactttgtatgtggctgacagaggccccttggggctggcgctgtgtccctgaacatccctgtcattctttggacacccttgtagaattctcagcacaaggcgctctggctcttttggggtgtggctcggctgctgctgcctggacgggggctgccactctagaccagctgcccagcaccccgagggtcccgccgcttgggactggggcccaagcaggtgtgctgaaggcctggctctgggccaaacatgtctcgctggctctcaacagagaactatagtgtcttttccaagtttggctcatttgtatacctgttgatcacctggtagacttagttcccctttccagcagtccggcgtctgttgccaatcacataaaagtcgactggtgtgagatgacccaagtttttgcaatgtacatgttcatttttaggggtggctttccggagtctgttttgagtaagaaaagtgggatctggccaagctctgcctagcccttgtcaaagatatctcattcaccttcctctggccgcaaggcccaatgtctgggcccactctgggctcatatttctgtaataacaaaaactgtcttttatcatggaagcaataactgaggggtgtgtgaggtttaagtagtttgacaccaaggtcaaatgttgtgtctgtttcttattttacacacatggatttaacaaataggtacagctgccccttccacaccgccccaggatctgttctcagtgggaggacagcgcgaggccttctgcgcaaatcccgtcctcagcacctgaggctgtgaatctcagaccatttgccgaaacacacgtgtgcaagcgctcagtcgctgccccccagcctcatcctcaggttgctcctgatacctcggccacaattgcgtgaggtctggaagccagggagcgtttgtgttcagggcggggcggcatgcagcccccagccctttcttccaactcccgagtgaggatcactcagccttgcttggacgacagatgctcagagttgagtggagccttgcccagagcccagcgctcgcgggctgtacccatccctgccagacccagaaagaggcccagctgcagggaatcagggaagcccagggctgggtgggtgtcggcccagagcccaaccacggggtggggaggggggcatccacaatccacagtctccgggggacgtaaccgcgccctgctggcttcagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacagtg

SEQ ID NO: 283858 - DNA, 1184 bp, Homo sapiens
ggccttgcctgtcactttttccagaggcgagggtcgcggaggggacagcgtcagggccgctggggtgtggacggcgggcgaggcgcaaactttactaggagtttttggcacttggaggcagagcctgttgggcggcacagcacgcccgctgggaaacgcaggggagcggcctgcttcgctgaaaacccgaccaggacctaacgggccgcgggacagaaacctccgagaccatggtacacagcaactaccgcaactcgctcctcagcccctgactcttcgtccccgccccacagagcagtataagtagggcccgaaacagaactggcaaccgcagtagccaatctacttgccaacatcactttgacagcccaatcacgatgaagaggaggcggggagaccgcggagtctccctctgttgcccaggctgcagtgcagtggtgtgacctcagctcactgtgagctctgcctcctgggttcaagcgattctcttgtctcagcctccccagtagctgggactacagatgcacgccaccacgcccggctaatttgtgtatttttagtagagacggggtttcaccatattggtcaggctggtctcgaactcctgacctcaggtgatccatccgcctcagcctcccaaagtgctgggattacaggtgtgagccactgcgcctggcccaatagaggcacgtttgtcaagctattgtgagtaactttcagaatgtttttgttctcaagatacgggatcatggtgggggaggcatgctgtgtattggagtgcagacatggtgtgtgttgggttgcacactgtgtattggggtgcacactgtattggggtgtagatgtgtgggggcgcacactctattgaggtgcacattgcattggaatgcagacagtgtttgctgggatgcacatgtgctgtgttggggtgcacactgtactggggtgcagacatggtgtgtgttagagtgcacagtgtattaggggtgcacactgtattggggtgtacactgtactggggtgcagacatggtgtgtgctggggtgcacactgtattggagtgcacactgtattgggatgctgatgtggtgtgtgctagggtgcatactgtgtattggggtgcagactgtatgctgggttgcacactgtgtatcggggtgcactgtgttgggatgctgatggtg

SEQ ID NO: 283859 - DNA, 2693 bp, Homo sapiens
caccggtcccccttcctgccaacgctgcatttggctcgggcccggtccatggcggcccctcggaccctgcgctgagccccggaggccagggcgtccggggctgcgccacttccgagggccgagcgctgccggtcccggcggtgcgacacggccgggaggaggagaacaacgcaaggggctcaaccgtcggtcgctggagccccccccggggcgtggcctcccgccccctcagctggggagggcggggctcgctgccccctgctgccgactgcgacccttacaggggagggagggcgcaggccgcgcggagatgaggaggaggctgcgcctacgcagggacgcattgctcacgctgctccttggcgcctccctgggcctcttactctatgcgcagcgcgacggcgcggccccgacggcgagcgcgccgcgagggcgagggagggcggcaccgaggcccacccccggaccccgcgcgttccagttacccgacgcgggtgcagccccgccggcctacgaaggggacacaccggcgccgcccacgcctacgggaccctttgacttcgcccgctatttgcgcgccaaggaccagcggcggtttccactgctcattaaccagccgcacaagtgccgcggcgacggcgcacccggtggccgcccggacctgcttattgctgtcaagtcggtggcagaggacttcgagcggcgccaagccgtgcgccagacgtggggcgcggagggtcgcgtgcagggggcgctggtgcgccgcgtgttcttgctgggcgtgcccaggggcgcaggctcgggcggggccgacgaagttggggagggcgcgcgaacccactggcgcgccctgctgcgggccgagagccttgcgtatgcggacatcctgctctgggccttcgacgacaccttttttaacctaacgctcaaggagatccactttctagcctgggcctcagctttctgccccgacgtgcgcttcgtttttaagggcgacgcagatgtgttcgtgaacgtgggaaatctcctggagttcctggcgccgcgggacccggcgcaagacctgcttgctggtgacgtaattgtgcatgcgcggcccatccgcacgcgggctagcaagtactacatccccgaggccgtgtacggcctgcccgcctatccggcctacgcgggcggcggtggctttgtgctttccggggccacgctgcaccgcctggctggcgcctgtgcgcaggtcgagctcttccccatcgacgacgtctttctgggcatgtgtctgcagcgcctgcggctcacgcccgagcctcaccctgccttccgcacctttggcatcccccagccttcagccgcgccgcatttgagcaccttcgacccctgcttttaccgtgagctggttgtagtgcacgggctctcggccgctgacatctggcttatgtggcgcctgctgcacgggccgcatgggccagcctgtgcgcatccacagcctgtcgctgcaggccccttccaatgggactcctagctccccactacagccccaagctcctaactcagacccagaatggagccggtttcccagattattgccgtgtatgtggttcttccctgatcaccaggtgcctgtctccacaggatcccaggggatgggggttaagcttggctcctggcggtccaccctgctggaaccagttgaaacccgtgtaatggtgaccctttgagcgagccaaggctgggtggtagatgaccatctcttgtccaacaggtcccagagcagtggatatgtctggtcctcctagtagcacagaggtgtgttctggtgtggtggcagggacttagggaatcctaccactctgctggatttggaaccccctaggctgacgcggacgtatgcagaggctctcaaggccaggccccacagggaggtggaggggctccggccgccacagcctgaattcatgaacctggcaggcactttgccatagctcatctgaaaacagatattatgcttcccacaacctctcctgggcccaggtgtggctgagcaccagggatggagccacacataagggacaaatgagtgcacggtcctacctagtctttcctcacctcctgaactcacacaacaatgccagtctcccactggaggctgtatcccctcagaggagccaaggaatgtcttcccctgagatgccaccactattaatttccccatatgcttcaaccacccccttgctcaaaaaaccaatacccacacttaccttaatacaaacatcccagcaacagcacatggcaggccattgctgagggcacaggtgctttattggagaggggatgtgggcaggggataaggaaggttcccccattccaggaggatgggaacagtcctggctgcccctgacagtggggatatgcaaggggctctggccaggccacagtccaaatgggaagacaccagtcagtcacaaaagtcgggagcgccacacaaacctggctataaggcccaggaaccatataggagcctgagacaggtcccctgcacattcatcattaaactatacaggatgaggctgtacatgagttaattacaaaagagtcatatttacaaaaatctgtacacacatttgaaaaactcacaaaattgtcatctatgtatcacaagttgctagaccaaaatattaaaaatgggataaaattat

SEQ ID NO: 283860 - DNA, 227 bp, Homo sapiens
ctcccagtctccctgcccggccctgggtcgcagtcctgggccggagctgaggccgcgggggagttggctacatgggtgaacttcttgtcccttcaggctgccggtcccggcggtgcgacacggccgggaggaggagaacaacgcaaggggctcaaccgtcggtcgctggagccccccccggggcgtggcctcccgccccctcagctggggagggcggggctcgctgc

SEQ ID NO: 283861 - DNA, 805 bp, Homo sapiens
ccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaact

SEQ ID NO: 283862 - DNA, 1786 bp, Homo sapiens
ccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgttttttgtttttgtttttgtttttgttttgcacagcataatgttaattcagattgttgaagctttcttgtagttatttatttatactcaatgtatgtattaaagaatgaacaatgtctcaagaacagcaagttgtaaacttttgaatgtataaatatcttaggtccaaggggagaaaattacatattacaattatgaaacaggtgaatttctgctttaaagaattgagattctccatacccctaaacttaggatctcttgatataaactgctgtaagtgcttttgggaaacctttgcaaaaccattttgataaaactgctttccaagttattgttggttatgtaaaattctatttacattgctttttctccttactgggaattagcacattattggcttccttaagactaattatttctctcttgatttatataatagctcattaagttgttattaatcaaaaacacaaagaggtgattgcttagacaatttttaaagtgactatagtataaacttttaaaagaataatatgaaaatgactgtggaatgcagtgtaaagcagaagcaaacggccctgaataacttacttggaagtaatttatatcaacttaagctgttagctcattgtataacttttcttatgtgaccctcaccaatatccctaagtaatgcctttggaagcttcagagtagaagatgcttcctactgtgttggctctgaggagatagtaggattagataggatccagattaggaa

SEQ ID NO: 283863 - DNA, 655 bp, Homo sapiens
ccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcaggttggaattcttgttagcaccacgtttcgagtgttgtgatgacacacttttgatttacatcgattcaacgtatcgcatgcacctagtaatggacctcagatacagcttgctgattaacacttattcaatggtacgtccaactatcacttggctgagagttctgcagctggactaaagacaacaatgagtactaggtgtcctaggagcttggcagaccgccttccg

SEQ ID NO: 283864 - DNA, 462 bp, Homo sapiens
aggaaaaagcttttacacttacattctacacaggaatcagaaattttggaggtagagcccaacaatctgtgttctaacaagccctctgcaggtctcaatgcattctgatgtttgtgaaccactgaagatactgcctttctttctctaaaatgaagtattgtttgttttccccagtagcgttcattgaaattgtggattattattttgtttcttccaggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaac

SEQ ID NO: 283865 - DNA, 376 bp, Homo sapiens
ggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaa

SEQ ID NO: 283866 - DNA, 531 bp, Homo sapiens
gcggccgccggcatctgcccaactcgctcgcgctttccgcccagggttctgaaaaatagaagaaaaaaggacaggctagagtgcagtggcgccatctcagctaactgcaacctctgcctcccaggttcaagcgattctcctgcctcaacctcccgagtagctgggaatacagctgcacgcttccattcccagccccagccagagaagaggagccaactcctcacggcagatcccttgatagaggaggatgaaccgaatccatgaccctccagacccgggaagcgacgcaccctaggccttggcaccgcaaagcccgtgctgagcgcacggacgggtgctgcccgggactcggccaggagggcgcccatgccaacgcctcttgcaggattagtgccttcggttggcaaaaggcggataaaggaagagcgaaaccacatcaggaagctaagggtggtccacgctccctgtccttttacttcccgcgccaaaggcacagtgaggcttgcttagaaaagtccatcccgcgattgg

SEQ ID NO: 283867 - DNA, 547 bp, Homo sapiens
aggaaagaaaatctcagcgtcaccatggactctggattttgctactgctccttttcccactccacctcttgctgactgtgtgtcttggctaagttttctcactcttctatccctcagttgcctcatcagtaaaagggcagtggtaacaccagcctctttgggctgctctgtgctgactagacgtggtattacataaacagcactggcacagccctgcctagggaagtcacccacagagggcccgtgtgtacaaaggtgttgcttgtatcctctggccatctcggtgccatcttcctggctcctatctccagccaatcagtcacctgacttgagaagtatctcaatttgaggcactggtagcaaaatataggaagctaaacaagtgatgtatgattatcagtgtcagttgaattccaaaggcatcaaaaaaggcagtcaattcaatcagagagagatggcggattttcttcatgtcttcagcagacagatctcctgcttcagttaagccaaatctggttttctgaacattaaatttctaaaacacaca

SEQ ID NO: 283868 - DNA, 499 bp, Homo sapiens
agcgcctcctgcaagacctggaagaaagaaaagtaacgattcttctcggccagagagagaagcatgaccggttttgcataccctgtccccagaaaaagcactctaagagtaggcgcgctactcctgggcgaggaaactgcggaagtgaggcattggtgccaggttcaaagatggcgctgagcagccaagcgcagaagcgaagagagggcggcagcctgcggccgtggccggcccgcgaggtctgggcctgggagcgcagatctggctgagcagctgattcttccagcagatccgagaaccgcgccactcgaacaggctgtcacctcgaagccaagtgatctccctttaatcctcagtctctgtctcaatagaatgatgatgaaaaatattcctacggagatcctaaatgtggttaaaaagctgggaggcccaaatgaggtcttctacagaaacatgcttattaaatcgaaattaaaagcaaataactaaaaaaaaaaaa

SEQ ID NO: 283869 - DNA, 884 bp, Homo sapiens
acttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggtgagagctctgcagctttcagcaggggccaaggacaggaagcaggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacc

SEQ ID NO: 283870 - DNA, 1635 bp, Homo sapiens
ccacacaggtgaataattcgataaaacccctaagagaacgcatctgtgtgtcaatgcaagagaaaaaaattaagagggtgtaaatccatctgttggaagatcaacaattggaacgagtttggaaatgttcatctggacagaagtaaaaatgaaaaagtatcaagaaaatcaaccagtcagacaggaaataaaagctcaaaaaggaaacaggtggattggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattg

SEQ ID NO: 283871 - DNA, 1897 bp, Homo sapiens
ccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagtttggaaatgttcatctggacagaagtaaaaatgaaaaagtatcaagaaaatcaaccagtcagacaggaaataaaagctcaaaaaggaaacaggtggattggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattggccactttcctttgaaactttattttcctcttcgttcatgaaactgctctcatcatttttatattgttccagggaaggagcaataactgatttttctgcagtgtcttccttctgaaagcctttccc

SEQ ID NO: 283872 - DNA, 1771 bp, Homo sapiens
ccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagtttggaaatgttcatctggacagaagtaaaaatgaaaaagtatcaagaaaatcaaccagtcagacaggaaataaaagctcaaaaaggaaacaggtggattggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattg

SEQ ID NO: 283873 - DNA, 1771 bp, Homo sapiens
ccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagtttggaaatgttcatctggacagaagtaaaaatgaaaaagtatcaagaaaatcaaccagtcagacaggaaataaaagctcaaaaaggaaacaggtggattggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagaatggagttcagaatactgaatcaacacaagaaaagagagaaattggggatgaagaaaactcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattg

SEQ ID NO: 283874 - DNA, 406 bp, Homo sapiens
ttctccagcagaaactttcttgtgcaggaactgatgagaaagaaatgagttcattaaaaaccaagggaaggaatgatgccatcctcacctactgaggccaggttccggaaggtctccagcatcacatctctgtagaggtccctctgagcagaatccagcaaagcccactcctccagggtgaagtccacagccacatcctcaaagaccactgagtcctaagacaaaccacacaggtgtgcaggaggattggagacactgaaagtactggggaactggactcaattcataaattcaaacaagattctgtggtgtcccaacacctcctctatgacgcgaatgttagatcttttacttattcacaatcacttcctagtaaacttcatggcaccactatcagtctgaactt

SEQ ID NO: 283875 - DNA, 752 bp, Homo sapiens
ccagctgtatcttcttttaccgatgaggacactgacagagacagggtctcactctgtcacccaggagtacagtggcacgatcatagctcaacgtaaactggaacttctgggcttaagcgatgctctcgcttcagcctcccaagtacctgggaccacagcagggaaaaagcaaatcctggaggaagctcaccttctccacactgctcatcgcctggaaatagatgttgtatcctttgcgcggagccaaaggagggttccaaaagccttgtccttcaatccacatttcaattaacttccttgttctcccaatacctcatattgagtgatgattccatttggatccaaaggttctttccagttcaagaagatcttattttcaaaggatgttccttgaagagattttactgtgaacttcacacatgacattatccagaaatgtagtttcaaagtatatagcaattttgtgaggattgaaataaattaaaaatcactggatcaagggaaatacattgcattgtggctaggagcatcaagaaattctgaatgatatctcacgagagcaggatttatttcaatctacaaggagactatgaatgatactatgacctctgagacaggcaacataatttgatacattgaggaaagaaacccacaataaacagaaaatatgccagcactaaactttagaagatatgttcaagccattgtcagccgaagactatgagagaagttaactgaatgcatccgctctc

SEQ ID NO: 283876 - DNA, 433 bp, Homo sapiens
aaaaaatgtgtttctttttgaaaatatcaactgaatattgggcaagcatagtttttaattaatattttcccttaatctaacgtttcagtgaacttcacacatgacattatccagaaatgtagtttcaaagtatatagcaattttgtgaggattgaaataaattaaaaatcactggatcaagggaaatacattgcattgtggctaggagcatcaagaaattctgaatgatatctcacgagagcaggatttatttcaatctacaaggagactatgaatgatactatgacctctgagacaggcaacataatttgatacattgaggaaagaaacccacaataaacagaaaatatgccagcactaaactttagaagatatgttcaagccattgtcagccgaagactatgagagaagttaactgaatgcatccgctctc

SEQ ID NO: 283877 - DNA, 323 bp, Homo sapiens
attcataactgtctaacataagttatgtccctcttaagtacaaaattattagcataatgataagatagttaacacatgtactgtttataatatgttaagcactatttaagcacttcatatatattttattttattattttagagacagggtctcactctgtcacccaggagtacagtggcacgatcatagctcaacgtaaactggaacttctgggcttaagcgatgctctcgcttcagcctcccaagtacctgggaccacaggtgagctccatcaagcctggctaacattttttttttttttaaattttcagtagaaacaggg

SEQ ID NO: 283878 - DNA, 797 bp, Homo sapiens
gccgccaactcacactgacgttccggccagggttctcgttcgcgcccgccacctgaggtcccgcgatcgggccgccgggccgtacgcagtagaccaggcagagcggggtgcgcgccgcccgtgccaggcagtagagctcgtaacggaaacctttgatgtagttaagcgagtccaggatgaccacgtcgtggcgactcaggcgccgttccacggaggctcgcagagctccacgcaatgccttctcacgggcagaatcgccgtacaccgctgggtcctctgcgcccaggacagctgcgtcgtccaccacgtacaccgcgcggccctcggcagccagcgccacgcgcaactcttcagcacgccggctcttgccgctgtacggcagcccgcaaaacaccacgagcggcatcctctcagggagcgaccattggcaaccgcgctgcgccaacttccgggttgtacgcgtctccgaccatgggatgctgtcacttgcctaaggctcaagatttgactctgaagagtgagtgattgagaatgaaattgagaggatgcccaggagaactgcaaggtgtctaacatgatcaccatcactctattggtcaatatctaaactcaggcaactgaatcctgctttggcaagatgcccaaccagacagtctgaagggatatacacctacaaaacaatgaaatcctagataaaatggactttcagaatgtgctcactagactcagtaatgacagaaccctccataaacacaaagcaagctaaaacctatgagcaacaagcaagtgaggctgcc

SEQ ID NO: 283879 - DNA, 346 bp, Homo sapiens
ttctgtagatcacatattaatttcatgtgaaaaaaatttattggaaaatagggaattttaacaacagaagaaataactgagattaaaacgtggaggaaacgaacctgatatttacttacttcaagatcatagaaaatactcgtgtttcagcatcaaatattacagaattaaatcctaaattaattccatttatgtttatgtctatacagactcaaactagctaatgtaagatatgcaggagaattcttaatatgatatcaatgccttctcccaagtcatcccttataatgtaatccccaggcttttgacaaccaagtgctgttgaggaaaatcaatccagtcatct

SEQ ID NO: 283880 - DNA, 889 bp, Homo sapiens
aattatttcaccttcttgaacttgcattgtagaggaagacaactttcactcttattcttcctctacttctcaccactaaagttactaaaaacgatttagactccaggtggtttgtgaggcaggagaatagggtccggaggcagggaacctaaggctgattcacctgacgtcctagaactaaatagaaaggaaaaccccaactttccaggccttagtaacagaaggaccacagcgtactccctttgcaaacttccttgttttctgagtggtgatggaaaattgaaagtacctctgattggttgcagaaagtactgtaaaatgttgattgcgggccaccacttcatttacatgaggtgaacaccaagtggccaatcggaaacctctagggaggtatttggacctgagaagattccgtactgttcccttgagctgctgctcgcgcactcccacagtgtggagtgtactttcattttcagtaaatctctgctttcgttacttcattctttcctcgctttggtgtggattttgtccaattctttgttcaagacgccaagaacctggacaacttgcagtcaagatcctctaccactaacactttgtatatttcaagaaagcctgacttatgcatgtatctattatttttaataattcaaaatctgtgcctcagtcttccttctgggtctcaaatgggcttctttttcaaacagaaagtactgatagacatttatttttctgtgaaaatttaaagagaatagtgataaacaggagtaccatttattattaagattgtgagtaacattatatatatcaatataacatttccttctccagaactttcgttatgtttggaaaatctgtttagaatgtaacagtagtcttcttttctcct

SEQ ID NO: 283881 - DNA, 554 bp, Homo sapiens
atctcacttcttaaggagagcaagactcctgccatcctagaagcctcagctggagctatccagaacttgtgtgctgggcgctggacggtaccttttagaaaagggatttggagatgggaaaacttagataactagtttgctgccatttgtaatttgttccacccctttctatttgctattctagtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtgaggagttgaatgctaactgttacctcaaaatttagtacagtgtttgtagtccagcaggtgcctaataatttattgaatttattgaaatgactgaagggaaggaccctcccccgcttcatagtttatgaatgcgagagttggtaagggttttagtttaatggttcttggaaagaaaacaagtgacaactcttcaaaaataaaataataattgctatt

SEQ ID NO: 283882 - DNA, 2623 bp, Homo sapiens
  misc_feature (356)..(356): n is a, c, g, or t
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactgggtcatgacccatangctatatctgggtcgcgcgaaaacccaaggcacaacgcaacggcggccacgggttggggccctttggccctttgggccaaaggaaaacgccccccaaacctttggggaaaaccaaaccttggggacaaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283883 - DNA, 2657 bp, Homo sapiens
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgtgagtgagggctgggcaggggccagggccgggcaggagctggggcaggggcaggggctgaggagcatcaagcttggttagcactgtccccctcacccctctcgcccaggagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283884 - DNA, 2711 bp, Homo sapiens
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtttaacaacaatgaaacacaccaacaaacaaaaccgcggggcccaagggcggggggggaaaaaaagggttggacagcggccccgggccactcgggtccggacccccttcttgtccaaggggaaatgggcggcccccataggggccataatggaaccgggaccgta

SEQ ID NO: 283885 - DNA, 2416 bp, Homo sapiens
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283886 - DNA, 900 bp, Homo sapiens
cggaggtatctacaggatcttagtgagcaagctggcagcccgtcaccagtatggtcccgcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283887 - DNA, 2496 bp, Homo sapiens
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctcctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283888 - DNA, 2548 bp, Homo sapiens
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283889 - DNA, 1780 bp, Homo sapiens
cgcgcggccccctccagcagcccctatgagtgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283890 - DNA, 1404 bp, Homo sapiens
  misc_feature (33)..(33): n is a, c, g, or t
acgatctatgagcggtctcgtgctggaggggtngcgccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283891 - DNA, 1060 bp, Homo sapiens
gagattgtgcggctggtacccaccctttgggaggagtcacggtccaggtgcccatgtccaccttgcagcctggcgcagtgcagatctgcaccttggcggccccacgtgggcactgccccttcccaggctcacatgctgtcaccctgatggggaggtgggggctcggtgactctggaggaggggaatagtgcctggcagcccgtcaccagtatggtcccgcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgtt

SEQ ID NO: 283892 - DNA, 1593 bp, Homo sapiens
tggggaggggctgaacccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggaatgggtggttgccgcttgcctcagccgtacaaggccgcaggcagttcacagcgaggggcaggcaatctggccacatggtgccctatctttcttcc

SEQ ID NO: 283893 - DNA, 3357 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283894 - DNA, 3219 bp, Homo sapiens
aactcaggggcgagctgcgggggcccggcgacactgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacaggtgaggtccctggagccagaagggattgccggctgggacgccagaaaaaggaggtccaccctgtctctcttacttctccccagctggaggagctgaagcagcagctggaacagcaggaggaggagttgggtcgactgcgcctgggcgtggtgaggctgcagggagacctggcagggccgggcatggagggggtgcttcaggtgagtgccgaggtttcctctccaccagggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggtaagggttggggttggggctcatgggaggccctggaggctgggccttcccttccaacagacttccctctccaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283895 - DNA, 3189 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283896 - DNA, 3277 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283897 - DNA, 3544 bp, Homo sapiens
  misc_feature (3204)..(3204): n is a, c, g, or t
  misc_feature (3206)..(3206): n is a, c, g, or t
  misc_feature (3222)..(3222): n is a, c, g, or t
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactcccaaaaaaaaaaaaaaananaaaaaacaaacaaaanaaaaaaaaaaaacataccagaacacaaataaaagaaaacggagggggcgggccctgacacagaagacccctcccccgcgaggcccccccaaatgcatagagtgccgcccagcaccacatgttcatgtgaccaccaaaagggggggcccccaacaacgggggcgacgcgccatcaataaacacacacagcgaggcgcgagcgacgcgtgaatcacaacccgctgcgtgatcgcgggaaaccacacgccgcgcgggacaactcttggggagcaaaacaccctcccaccggggggcggacacacaatcgggcgacacacagacca

SEQ ID NO: 283898 - DNA, 3136 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283899 - DNA, 1534 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggtaagggttggggttggggctcatgggaggccctggaggctgggccttcccttccaacagacttccctctccaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttgctttgccgctgagtgtaggaaaaacaggcatgacagaccagggtgagggttgtgcccagctgggccacggccatgcgtggggtggcccaataaacaccgtggactccca

SEQ ID NO: 283900 - DNA, 1169 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacaggtgaggtccctggagccagaagggattgccggctgggacgccagaaaaaggaggtccaccctgtctctcttacttctccccagctggaggagctgaagcagcagctggaacagcaggaggaggagttgggtcgactgcgcctgggcgtggtgaggctgcagggagacctggcagggccgggcatggagggggtgcttcaggtgagtgccgaggtttcctctccaccagggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccaggtgggcatggggcccagggatccatggctcagg

SEQ ID NO: 283901 - DNA, 3431 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggtaagggttggggttggggctcatgggaggccctggaggctgggccttcccttccaacagacttccctctccaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283902 - DNA, 1987 bp, Homo sapiens
cagagctgagagcccaccctgttagcagcgaccttctgggcataaaagccagccatgttgttgctcaaaagactgttggtgtccagtgccaatggggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283903 - DNA, 3269 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283904 - DNA, 1538 bp, Homo sapiens
ggacgcgtcgcccacgcgtcggatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccca

SEQ ID NO: 283905 - DNA, 3301 bp, Homo sapiens
accggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggtcgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactcccaaaaaactaaaaacctacaatagaaaacaactttaaggaactacaatatttaaccaaaatatatatgcgcaactgaaaaagaattgattcaaaaaaaaaagcaaaaagcctgggggggggggctttcccccatggggccctctggtggactttgtgaatatgatgg

SEQ ID NO: 283906 - DNA, 255 bp, Homo sapiens
aaaagggttcagcatctgactctggagaacgaggccctgaagcagagcctgagtctcatgcgggacctcctgctgcactggggccccgggccccccatcagggctccgcaggtactctgctcccgagctgcagccgttcctgcagcctggggctcttgcacacctggcatgcagccacagggcccgagcctcctcaggacctcccgggatggtctgtgtagggcagccccatcagggaggctgatgccaatggga

SEQ ID NO: 283907 - DNA, 593 bp, Homo sapiens
actgctctgagtaggggtatggagggccgaacagagacggaagtggaaggggaggcagctgggtgctcacccaggtagttggagctaggccggagctgggcaatctggagccgcaaggctcccgctggaatccacaagatcttctgatagcccagggggccccctcggtcagtgaggttccccgaaacaaggcgacaggtagaatcatcacccccacagactccacagccatcaggacgcctgccagagccaaggatcccatcacagccggggctctggagagagtgaggtgaggcagtggccacagaacgccagacaccacctcaaccccaccccggtcccctcgggagcctcagctcactaccctgctttttgtgccacaagtgagagcacaaaaacagccccaccatccccagccagacccagggacatggacaggtgcccgatcagatccttcaggctctgctcagcgcagcttggcaggtgagaattctccctcagtgatctcagtatggtgttttgttgttgaattgagactgtgcaaatacgtgtgtgtgcatgtgtgcatgtgttcatgcatgtgtgtctacatg

SEQ ID NO: 283908 - DNA, 366 bp, Homo sapiens
ggtcagttgaggtcaccgagaccatcaaggggactctgaactgagagaggagcaatccctgatgcccatgattctgtgtgttcagagctcttgagtgcttatcccggtgtcaagttaacacaggcctaaaatgaagcggatggtaacctgggagcaaccgatacgacagtgcccaggatgcgtggcacacccccaccgggctgtcacggctggacaggatctctcccaccatggccctcttgtgtcacagccacctgacccccagtgatggccttcccaggggagtccggacaaagcgtgtctcccacacctcctcctcccaccccgacccttctgcagaccactcaccacctgtgctgtctcctg

SEQ ID NO: 283909 - DNA, 709 bp, Homo sapiens
ctcacctggctccaaggagagccaacttcccaatggccacagaggcgcagctggcaagactgggtgatgttgggccgggggagatgtccacagcgctccgggggcaccgaggagccaccccccccaaattcctgccggcactgcagctggcggtgctgggtgccggggccacaggagcggctgcaggatgtccactcgccagcctcccagctgcaggcaccagcagggcagggaagaggcggagacatagatgagatgtgtggggctgccgtggcagcagagatggaagacacactggacgtgggggcctcagagccaggagatgttgcgttgagtgcagagttcaggacccagggggatccacagcccagttcccattgatgatggaccggcccccagggccacgaagtgctgcgggtcagagactccacagccatcaggacgcctgccagagccaaggatcccatcacagccggggctctggagagagtgagtgagagcacaaaaacagccccaccatccccagccagacccagggacatggacaggtgcccgatcagatccttcaggctctgctcagcgcagcttggcagccacctgacccccagtgatggccttcccaggggagtccggacaaagcgtgtctcccacacctcctcctcccaccccgacccttctgcagaccactcaccacctgtgctgtctcctg

SEQ ID NO: 283910 - DNA, 729 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagataagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 283911 - DNA, 1722 bp, Homo sapiens
ggggcggagctggagggggtggttcggcgtgggggccgttggctccagacaaataaacatggagtccatcttccacgagaaacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283912 - DNA, 933 bp, Homo sapiens
atatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 283913 - DNA, 1117 bp, Homo sapiens
atatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcaggggcaggaggattgcttgagcctaggagttcgaggctgcagtgagctatgatcctgccactgaattctagcctgggcgac

SEQ ID NO: 283914 - DNA, 1175 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagtcctaaacagaccggacggtgtgaagcaatgtggggccgatgttccaaatagggattgcgaagggcgtgcaagtccaatgttgtgaagggagacctgggacttagagctgggccacaccttggtcgccgaacatgcgggagaccaagagtgtgttcctcctccgtccgcccgcactctatcttttctttctctctttttcccgaaccaaaaacagcacgagggacgggagggacgagagcccggacaggacggcggggacgacggcaccggagcagacaagcacagcgacgcaacgaagagaaaccggaacgcgacgcagcgagccagcacactcagaggagccgaggcgggagcaaggaacgccaagagcgcgggcgacgcggaagaggcgcggggcgcaagaggaggagggggggggaagagagggaagagacgaagagagggcgagagagcagagagcgggaggagaaggggacaggggcggagagggacgacgggcaagcgcaagcacgaggagagaaaagacagccgaccagagccgcaccgacgacca

SEQ ID NO: 283915 - DNA, 445 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctatactttcctatttcacctttgtgatgtccatgagcatctgccctgtagccttcctggcaccccagtgt

SEQ ID NO: 283916 - DNA, 1830 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283917 - DNA, 1952 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagcagcagcagcagcagcagcagcagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283918 - DNA, 1726 bp, Homo sapiens
gtccatctttcacgagaaacacgaggcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283919 - DNA, 1286 bp, Homo sapiens
  misc_feature (1231)..(1231): n is a, c, g, or t
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagcagcagcagcagcagcagcagcagcagcagcaaaagcagcagcagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagantcttaagtaaatttgtaatctactaaatttccctggattaaggagcagttaccaa

SEQ ID NO: 283920 - DNA, 1209 bp, Homo sapiens
aatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283921 - DNA, 1062 bp, Homo sapiens
atatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaaccaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcaggggcaggaggattgcttgagcctaggagttcgaggctgcagtgagctatgatcctgccactgaattctagcctgggcgac

SEQ ID NO: 283922 - DNA, 450 bp, Homo sapiens
  misc_feature (397)..(397): n is a, c, g, or t
aaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagagcagcagcaaaagcagcagcagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagantcttaagtaaatttgtaatctactaaatttccctggattaaggagcagttacc

SEQ ID NO: 283923 - DNA, 1887 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283924 - DNA, 1221 bp, Homo sapiens
  misc_feature (1166)..(1166): n is a, c, g, or t
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaagcagcagcaaaagcagcagcagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagantcttaagtaaatttgtaatctactaaatttccctggattaaggagcagttaccaa

SEQ ID NO: 283925 - DNA, 1916 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283926 - DNA, 1815 bp, Homo sapiens
gtccatctttcacgagaaacacgaggcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcaaaagcagcagcagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtg

SEQ ID NO: 283927 - DNA, 913 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagataagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcaggggcaggaggattgcttgagcctaggagttcgaggctgcagtgagctatgatcctgccactgaattctagcctgggcgac

SEQ ID NO: 283928 - DNA, 548 bp, Homo sapiens
cgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaacacccagcctgtggatgtctatatgatctttcaggaggaaaacccaggcgtttttatcagtatgtcatctcttcacctcctccaatccttgag

SEQ ID NO: 283929 - DNA, 771 bp, Homo sapiens
cttcctatagtcccaggctgctccagagccaagctaccctccggcatcgggtccctggtttccagaggagcccagaccctgtatgtcccacagaatctggacagagccaaaggggctccgccaggccaggaggaaaagttaaccccagcaggcggctgaagcccacgggaggaagaccccctggcccactcgggaggctgaggcaggaggatcgcgtgagcccaggagattgaggctgcagtgagctgtgactgcaccgctgcactccagcctgagcaatagagcaagactctgtctcaaaaataaattcacggaccaaaaggaggtctagaagccctggtctgagccccctccaatggagggtgaaattcccacgtgagccccagggcgggagaaggaggcgctccggagacgctgactctgcggccaggacgagtaggcgggactacagacccgcgccaccacaaccagctaatattttaattttttgtagagatggggcctccctatgttgcccatgctggtctcaaactcctgggatcaagaaatcctcctgccttggcttcccaaggtgctgggattacagatgtgagcctggtctgtgaatttgaatggggaaaaatccgacctttattctcaaatggcctctgatgtgactgcattcctctaattcattcaattgcggatataaggaagaagccacattcatagttgcagggcctgtgactttgtcaccaacagaattcacaggtacggtaatatttgggtaga

SEQ ID NO: 283930 - DNA, 452 bp, Homo sapiens
catggatcccccaatagcaactgcagattaagccaacaggcaggctgctgatagaacctgctccccttcttaccttggaatgcccacacagggctgtgagggaccaaccaaatatgaagctgttgatttctccaaaataaccatcaaaagtctgatgagataaagagcacactggaaactgggaatgctttgatggaaattctgcaagtaatggacgctctggcttgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggacagttgcttcagtaatt

SEQ ID NO: 283931 - DNA, 438 bp, Homo sapiens
tttcaggttgagaaaatccactcctaaggaagtcaagacggagtttcaccgtgttagccaggacggtctcgatctcctgacctcatgatctgcccgcctcggcctcccaaagtgctgggattacaggcgtgagccactgcgcctggtcggtggacgtatgctttcatttcccttgattaaatacctaaggatggaatggctgagtcacatgtgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggacagttgcttcagtaatt

SEQ ID NO: 283932 - DNA, 577 bp, Homo sapiens
ccggatggtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccagggctgtgagggaccaaccaaatatgaagctgttgatttctccaaaataaccatcaaaagtctgatgagataaagagcacactggaaactgggaatgctttgatggaaattctgcaagtaatggacgctctggcttgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggacagttgcttcagtaatt

SEQ ID NO: 283933 - DNA, 614 bp, Homo sapiens
ccggatggtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggaagatggagtttcaccacattgcccaagctggtcttgaactcctggactcaagcaatgccttggcctcggcctcccaaagtgttgggattacagcggtgacccacaatatctggcctttgtagcgttcttgtaactaggttaggtataactcagaaaatggaaataaacattacatatacaaagttaaca

SEQ ID NO: 283934 - DNA, 1065 bp, Homo sapiens
ccggatggtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttggtatgtacctaaagcttacagaaacctgtccatgtaaatgaaactgtgacattgtcccagccatcttgcttttgtttcaagcagtgatgattcaggagcccctttcatcccttcccctccaaaaaaggaccaatgatagagaacaaggaagaacattcccattgtaaggttgaaccatttagagtcaaactagcattgacatgtccatgtgataaccgttaaacaaatgatataaaccaatgagcctagtgtgaactcacataa

SEQ ID NO: 283935 - DNA, 788 bp, Homo sapiens
cccccagcgcccggcacagcccggaccccggtgtaaagtcgggcatctgcgcagtaaacatctggcctcggagctgtcctccgcgccttggctgccccagccaggggaaggatatgcggagggctctaagtcaaagcgggcgtttttgcgggtgtagacactgcggcgcctgggtctgcaggaggggcagattttcaggtggccgggacaggtgaaggcagagaggagtggctgtccacctggggaagcatcctgaaaacatcacacacagtggaccacgctttgccctcagagtgactgctccgacccggaaggagaggtcaacgacccctcaggacacaaagggtttcttaggttgttctgcgcagtcacatggcttccagaaccagaacgttcagctcttaaagtctgcacagaagaactgatagaatctgctcctttcaatggaatctgtgactgtttgggaaggatgtgcatggagaagggtctgatgaggctcctgatccaggcggtccacgtgcgttcagtgtgtttggaccctaggcacctctgtctattgctcggtcttgcgtacatagtccatagcttggcatcagcacagatcgatgcttagtgagcacaattaagaaaccaaactatggaaaattaaggacagtaacaaaagtatcatcaacaaaaatcaagcattttcctctttttgaaacaagaaaagcgcatcgtagaaaccaagattctgtacaatattctaacattatatgtacataaaattatattactcataaaaatat

SEQ ID NO: 283936 - DNA, 874 bp, Homo sapiens
agtgaacagtaagagctggctagtaatggccttaaaaagaaaaagggtaactctctgaaacaaagatcactttagtgtggcattgtggatgctgttaattctgcatagggaaactttggaacagcatgctaattacatggctgtaagcaaagccctgtcctctgtctctgcaccataccttcattggacttcaccaacccatccatactccatgtaaacctcagttctctcatgcctgccctaagtcagttgacatcagtgcagtggcattgaggagaaatgagaggtgtctctgattttactgaaagttattatcattttcacaggtgcctgagatttggtatctactttgtgttcttgattcttaggtgaaaaatctgaaatagttccctgtgcattaaaataaattattttgagaggactcctgctccgtcgattcagcagacctatgctgcagaaggtaactgcggaagctctcttttgctgtcagggctctgagcttgaagggagaaggtgcagtggtgcctagaagtgatatgcaaaccacctcacatgccagcctctggcctccttcccatcccagagtcacagacaggggacccagtgacaatgatgataaatccatgtgtggaggtgttttacttatttttctttccgtaggatttcatggtgctttaaaaaaaaaggcattttacagaaaataatgtggggggagggagatttcataatgttcttagggaaagtacaaaacaaatttgcttgtgacatttcaataagctgtgctgctattgtctttatttgatgatgtaatttttttttcaatgatggagaaaaattgcaacaaagaccttctggaagatccaatccaatgtct

SEQ ID NO: 283937 - DNA, 1404 bp, Homo sapiens
gtattagttgctgtctgaccttcctaggctaacccactgattcacctttctagagccagctttgtgttctttaaataaatgcacacaatggctcatgcctgtgatgccagcactttgggaggccaaggcagtcagatcccttgaggtcaggagttctagaccagcctggccaacatggtgaaaccctgtcgctaataaaaataaaaaatcagccaggcgtggtactgcacacctgactagggaggctgaggcaggagaatagcttaaacttgggaggtggaggttgcagtgagctgagatggtgccactgcactccagcctggacaacagagtgagactccatctcaaaaaataataaagtaataactaactaaataaataaatgcacatctgtgtgtctggtctgtatttgtattttcaggatctaatgaacagggagaagaaaaacaaaatcccaagtatgcaagttgggttcatagatgccatctgcttgcaactgtatgaggtatttatatgaaaactactagacttgctaaacttggactgttgtgaattagaacctaaaattgaagagattaatattaggcgcctatattttgcttctaaatcaagaaataaaattattagcagtatggtttcttttactgatgaacatgtttgtattgaacaaggaacacatactaatatctattgagtgcctactatgtgctaatctccaacaaattgatttggggatgctaagaagaattatgtgccagtgttaccctcaaggagcaatactgtatatactatgcgttagcatattctttttttaagtctaaattttagcctaaataaagaaaagtaatccaactttttctcattgtcataatgtggctttactctagttataaaaattcttctgagattaaaaggaaggaggtagaatattgcaggttcccatttccacgtatctgctggcttggcttttggagggggggtggttattgtaggcaaatagattctccctaaaacatctaacttattagtttagatgtttatgactcaaatgcagaaagaagaagttgtctttgtctttgaaggtttaaacggaaatgttttaagttttaattatttggaaaaagaacatttgtcatggagttatcatagaatgtcaagagcagaaaaaaaacctagaaatattctaatccagatatttcagatttagtaattgaacttgtaaagttcatctcccaacgagacagactatttgccccaaacaggtggttagtgggagaggtgcatctacagtccagttctcactcctactccaggattctcgccatcaaaagaatttaatataaagaactgtggctgacagggaaaggaaggagagataccaaaagaaccatggagaaaaaaaaa

SEQ ID NO: 283938 - DNA, 555 bp, Homo sapiens
gacatggactacttgtcttcgggtatcaagctgctgcttatttgctataaaatggagatatacagctcctaacagggccttcattcacggtctctgttttaaagaatgatatgcttttcattgtcaaaactgagtctgttatttatttcagatagcagaacttgtagcaactgaattttttgatcaaggagacagagagagaaaagaactcaacatagaacccactgtaagtatgaaaccttgttggtaggaattattcaaattgttttttttttaattgtagactcctttttatggctctatgggatctttccttaggaccacaatttctcattttattttttaaaacttttttctcattggaagaattatacatgttcattacagaaagcaaaaccaataaaaggcataataaagactcttgggttcatcatattgtatcagtgttctttgtaatttgtttttttccgcttaagtattagaaaccacttttcattttaacaaatattcttatgtattatcatgattacatgaaatcgatgtaaccataattta

SEQ ID NO: 283939 - DNA, 393 bp, Homo sapiens
agtgggcacatggtagaagtttgttattatatactcagagacagaagtgataaggactttaacaacactttgtttacacagaggtaggctgggtcatcaaagtgacctctgtgaggtcactcctcacagagaccactaggctcagaaatattgactacgtgtttaacttttatttctaagtagtcatttttatttgcataattatttgcagaatcaaaagttttctgcaaatttgattctgttggatacagaggtgtagatttgaaatttgagactgcttatgtcagttgcctcctttctgcattctattttgtatgtaaccgtgtgtgtgtgtgtgtgtgtgtgtgtgtgtgtgtgtgtatgtttaacttctggtttctcagtaaggaaagg

SEQ ID NO: 283940 - DNA, 373 bp, Homo sapiens
atcaacgaaaagcaggaagagttttaactcctggaatcatctgagaaactatttcaaactataaatttatataccctacttctgaaagttctgattcagcaagtcttgggtagaagctgggaatctgtatgactaccaagctcccccaggtgactctgaatgtgcaggtagcgagtgaagaaaccactggctcccagggactgaccgaggaacactctttctcacaaaggaccagccgactccaacagggttctgtcgtatcatgcttcagcagcagaggaagaaacaagagagctacagtcgttagcgggatgcaaagtcactgataatacaaagcaaaaggcattaaataacttatactgactgtgtaata

SEQ ID NO: 283941 - DNA, 5150 bp, Homo sapiens
gccgccgccgccgccgccgcctcctgggaaccaggggactgaagagcctgcgagagcggaacactgccggaccccgggtgggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctat

SEQ ID NO: 283942 - DNA, 3721 bp, Homo sapiens
  misc_feature (4)..(7): n is a, c, g, or t
  misc_feature (9)..(9): n is a, c, g, or t
  misc_feature (271)..(271): n is a, c, g, or t
gaannnngngtggagcagagagtgcttggcgggcgggtgccccgaagcctgaggaattgatgcatagtcggggtgcgtggactccaggacgcgcccctttgcagaaagagtccgtgccccgctgccgcctgctctgggcagcgccgtcgggcagcgggtgctgcctcttgccgggaggtgacacacgccggcagtgatggtcgaggagccgcccgggttcgacgcccgggtcccactcgccggcgcgcggccgcggctctgccggtcgctncgccagggggcggcgcagcgcggggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggtatttatatgaaaactactagacttgctaaacttggactgttgtgaattagaacctaaaattgaagagattaatattaggcgcctatattttgcttctaaatcaagaaataaaattattagcagtatggtttcttttactgatgaacatgtttgtattgaacaaggaacacatactaatatctattgagtgcctactatgtgctaatctccaacaaattgatttggggatgctaagaagaattatgtgccagtgttaccctcaaggagcaatactgtatatactatgcgttagcatattctttttttaagtctaaattttagcctaaataaagaaaagtaatccaactttttctcattgtcataatgtggctttactctagttataaaaattcttctgagattaaaaggaaggaggtagaatattgcaggttcccatttccacgtatctgctggcttggcttttggagggggggtggttattgtaggcaaatagattctccctaaaacatctaacttattagtttagatgtttatgactcaaatgcagaaagaagaagttgtctttgtctttgaaggtttaaacggaaatgttttaagttttaattatttggaaaaagaacatttgtcatggagttatcatagaatgtcaagagcagaaaaaaaacctagaaatattctaatccagatatttcagatttagtaattgaacttgtaaagttcatctcccaacgagacagactatttgccccaaacaggtggttagtgggagaggtgcatctacagtccagttctcactcctactccaggattctcgccatcaaaagaatttaatataaagaactgtggctgacagggaaaggaaggagagataccaaaagaaccatggagaaaaaaaaa

SEQ ID NO: 283943 - DNA, 1839 bp, Homo sapiens
  misc_feature (4)..(7): n is a, c, g, or t
  misc_feature (9)..(9): n is a, c, g, or t
  misc_feature (271)..(271): n is a, c, g, or t
gaannnngngtggagcagagagtgcttggcgggcgggtgccccgaagcctgaggaattgatgcatagtcggggtgcgtggactccaggacgcgcccctttgcagaaagagtccgtgccccgctgccgcctgctctgggcagcgccgtcgggcagcgggtgctgcctcttgccgggaggtgacacacgccggcagtgatggtcgaggagccgcccgggttcgacgcccgggtcccactcgccggcgcgcggccgcggctctgccggtcgctncgccagggggcggcgcagcgcggggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggtaaaacctttcctttaacctatactctaaacttatttttaaaaatgtattcccagctatacttctttctttcaaatgtaaagaataaaatgttttaaaaaagataaaatt

SEQ ID NO: 283944 - DNA, 1969 bp, Homo sapiens
  misc_feature (4)..(7): n is a, c, g, or t
  misc_feature (9)..(9): n is a, c, g, or t
  misc_feature (271)..(271): n is a, c, g, or t
gaannnngngtggagcagagagtgcttggcgggcgggtgccccgaagcctgaggaattgatgcatagtcggggtgcgtggactccaggacgcgcccctttgcagaaagagtccgtgccccgctgccgcctgctctgggcagcgccgtcgggcagcgggtgctgcctcttgccgggaggtgacacacgccggcagtgatggtcgaggagccgcccgggttcgacgcccgggtcccactcgccggcgcgcggccgcggctctgccggtcgctncgccagggggcggcgcagcgcggggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggtgggtgaagtttagggacctctcacactgtacagccaaaccctcatcttttacctttccctcat

SEQ ID NO: 283945 - DNA, 4415 bp, Homo sapiens
gccgccgccgccgccgccgcctcctgggaaccaggggactgaagagcctgcgagagcggaacactgccggaccccgggtgggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttcttgagatgagatggaatctactcctcgtgaagaggctgtgaacattgttgaaatgacaataggatttagaatagtacacacatttagttgataaagaagtggcagggtttgagaggattgactccagcatacaagcaggcccggtaatgggcctccacgatgtccctgccataggctctgtcccgaattc

SEQ ID NO: 283946 - DNA, 5163 bp, Homo sapiens
  misc_feature (4)..(7): n is a, c, g, or t
  misc_feature (9)..(9): n is a, c, g, or t
  misc_feature (271)..(271): n is a, c, g, or t
gaannnngngtggagcagagagtgcttggcgggcgggtgccccgaagcctgaggaattgatgcatagtcggggtgcgtggactccaggacgcgcccctttgcagaaagagtccgtgccccgctgccgcctgctctgggcagcgccgtcgggcagcgggtgctgcctcttgccgggaggtgacacacgccggcagtgatggtcgaggagccgcccgggttcgacgcccgggtcccactcgccggcgcgcggccgcggctctgccggtcgctncgccagggggcggcgcagcgcggggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctat

SEQ ID NO: 283947 - DNA, 3643 bp, Homo sapiens
aaccagttaagatttatcctaatgttgatgtaatcttccatttttattgactacgtgtttaacttttatttctaagtagtcatttttatttgcataattatttgcagaatcaaaagttttctgcaaatttgattctgttggatacagaggtgtagatttgaaatttgagactgcttatgtcagttgcctcctttctgcattctattttgggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctat

SEQ ID NO: 283948 - DNA, 604 bp, Homo sapiens
aacttgcttctgtgtttgtgtcttcaaaacagctgctatcaccaataattaaaccataaaaaaccgaaattatttttccctctggggtgattacaaccacacgggagctgtgatgagagctcagcaatcctgtgatataggcaaagcagacctgacagtcacaggggttccatctccaaagtgaccttaagatctgaggtgaccactgcaactccaagccatcctggttcaccaactgctagaaacacccagattttaactttccaactcacttcttccaagaagctccccctggtatatggccacctcctctgagaccacttcatcccactgtccattgtcaagagcatgtctttcactcagagaatcaaaacttttgttgaagacagaccttacaccatctggcctaatgatttgcaacttgtttttcagagccctttctgcaagtaaaaacatatgtgaaaccccaacatgatggataaaatgaataaaatgtagaatgggatggggcagaggagccccaagtcacttcagaacatagttagaaaagataatatcttgccctcattttatgaataaagacattgctgcccaaagatagaat

SEQ ID NO: 283949 - DNA, 637 bp, Homo sapiens
aacttgcttctgtgtttgtgtcttcaaaacagctgctatcaccaataattaaaccataaaaaaccgaaattatttttccctctggggtgattacaaccacacgggagctgtgatgagagtcacaggggttccatctccaaagtgaccttaagatctgaggtgaccactgcaactccaagccatcctgaaagctattcttgtgaccaaatcaacagctctttccaagaaaaaaagaccttattgatgtgaagtcttgacactgcctcctgggagcatcgtcctgtaatcaagggcagaaaactctgtgtgtgtacatgtgtgtaaatgcatgtgtgtgcccatagggccaccattaggctaaaaggcccttatgacatccatgtgggaattatttcctcctccctccaggcagatgcagccccatgctaacttgtggaacaggtttggtttcaggccgcacttactcttttgaccaaagttacaactgttcacaacacctgtgtgtgtgtgtgcgggggggggggggggtgtctatatgcgaagatttcaaaaacatatcagaaattactcccaagaggtatccctttttatctggagggcataacatcgttctagatttatacagggaggtggatat

SEQ ID NO: 283950 - DNA, 291 bp, Homo sapiens
aacttgcttctgtgtttgtgtcttcaaaacagctgctatcaccaataattaaaccataaaaaaccgaaattatttttccctctggggtgattacaaccacacgggagctgtgatgagagatgaaagaactgaccctcaaggagaccaagggataatgaccatgatgatcacatgatagcccagtcaaactggccacttggttctcaaaccctggccttttaagtcaaaattgtattactacactaaatgtaaaatggcatcttaccaaaataaatggaatctttgaagaga

SEQ ID NO: 283951 - DNA, 587 bp, Homo sapiens
tctgaacctcacgtgtgctgttgcctcaggccctccacgcgcccatccctgtcctgggagcgcctttcccagatgcatgctcggctcctctcccacttgcgtaggcctgtactcagatgacttcctcttagtcatcttgttagcaaagctttccttgaatatcctgccgaaaatattcctgctgggtgcagcggctcacgcctgtgatgcaaacactttgggaggccgaggtggaagggctgcttggggccagaagttcaagaccagcctgggcaacctggagcctggtccaaagacagctgacccccgaacatcacacggtgtgaattgcgtcggtccagttatacttacgcgcttacccatggattttcctccacccctgagacagcaagaccagcccctctcctacctcctcctcctcctccgcctactcaacgcgaagactacaaggaggaagacctttatgatgatctacttaataaatagcgagtacattttctcttccttaggatattcttagtaacatttttttctttagctacttgattataagaatacagcatatagtacggccgggcgcggtggct

SEQ ID NO: 283952 - DNA, 840 bp, Homo sapiens
ggtcaccttctgtgttcaggttggagtgcagtgagctgagatcgcacgactgcactccagactgggtgatagagtgagactctgtcgcataaaaaaaaagaaataaaaatagaaaatacaagcgcccgtttccgggcgcggtaatgggggtatgaatgggagaggcgtgattgtcactgtgggccaggcttggttcggctgaaacggggaacatccagcgggtcaccgccatgatgaggcatcacactatatatgggagagacgacggagggaaaggggcgtgcttgagagggacagtaggaacaagacagcctgggcaaccctgcccccaccctccaggcggtcagccctgtgctgagtctcacctcctcttcaggaagaaaatcagcaggcccacgaggatgagaaacaggaggatgcccacaaaggctccggcaatgacccctgtggggaggaggcatcgggaaccctcagagcgcaggtctgagctgctcatctgtctccaaccctgcccagcctttcctcttccccaggagcctggtccaaagacagctgacccccgaacatcacacggtgtgaattgcgtcggtccagttatacttacgcgcttacccatggattttcctccacccctgagacagcaagaccagcccctctcctacctcctcctcctcctccgcctactcaacgcgaagactacaaggaggaagacctttatgatgatctacttaataaatagcgagtacattttctcttccttaggatattcttagtaacatttttttctttagctacttgattataagaatacagcatatagtacggccgggcgcggtggct

SEQ ID NO: 283953 - DNA, 1144 bp, Homo sapiens
aaactgtgctttatttagggctaagctggagaaagcgtcatccaatagttacagaaggttacaaggagttttagggagttgagtgtgaaaagagcagttgtactgaactgcagctgttttcttttttttttctttttttcttttttttttttttttttttacatctggacatcctaaaaggaggagtcaagagaaaaaaagaaaatgaaaaacaacaacaacaacaaaattgacagaaagaaaggaaaggcaggaggccctagaggaactggaaatttgttcttctaaagggaaactggtaggtctgagaacccccggcctccagatgacctggacatcaatgagaaggaatcaaggcagaatgccaaagcaatcttcccaagggtgcaaataaattataataaatatgttatactttaaaatatatgtgttcttaaataattcagtgttttttctgattctgagttttttaagcaatgtctttaactgctctaaagtcatttaccaaagataaatatcgtgctttcattaaatagttttccttgtttttttctctatcattacaattaaaagtcctacaaaatatgcaaatttatttacagaaaaacagagccggcatcatttaaacatccctgtttttcaaaattccttgtaaacagtttcagaaattcttcaaagattgtttatttttctctctcttttttaaggttttgtgtgtgtgtgtgttgtctagttgttttaagatgaaagttcccagttctcccttgcccggaaagtctctggagcaagcgtggaaggcgagtgaagcggaaggtgagtgaagcgcgcgcagctcccagagggaagcgagaggcgaggatgacggcggcggcggcggcggcgacccgggcgacgcgaccgttcccgaccgacggcgtggcctccaccggcgtcggcagccaggcgcccgcaggtgtggggcgagttcggcctggcccttggggacaacggcatccgactgcactcgcggggagaagggattgatgctctgtctaaactctacaaaagtacagtcctacaacatctgggattttagcagtaatgctaacttctataggttttttttttccttttttattttttttttttattttttgctttcctc

SEQ ID NO: 283954 - DNA, 1143 bp, Homo sapiens
aaactgtgctttatttagggctaagctggagaaagcgtcatccaatagttacagaaggttacaaggagttttagggagttgagtgtgaaaagagcagttgtactgaactgcagctgttttcttttttttttctttttttcttttttttttttttttttttacatctggacatcctaaaaggaggagtcaagagaaaaaaagaaaatgaaaaacaacaacaacaacaaaattgacagaaagaaaggaaaggcaggaggccctagaggaactggaaatttgttcttctaaagggaaactggtaggtctgagaacccccggcctccagatgacctggacatcaatgagaaggaatcaaggcagaatgccaaagcaatcttcccaagggtgcaaataaattataataaatatgttatactttaaaatatatgtgttcttaaataattcagtgttttttctgattctgagttttttaagcaatgtctttaactgctctaaagtcatttaccaaagataaatatcgtgctttcattaaatagttttccttgtttttttctctatcattacaattaaaagtcctacaaaatatgcaaatttatttacagaaaaacagagccggcatcatttaaacatccctgtttttcaaaattccttgtaaacagtttcagaaattcttcaaagattgtttatttttctctctcttttttaaggttttgtgtgtgtgtgtgttgtctagttgttttaagatgaaagttcccagttctcccttgcccggaaagtctctggagcaagcgtggaaggcgagtgaagcggaagagaagcataaaaaaacgctgaacaagaaaaaccaaacaacagaaagtaaaaccactgcaagcaccaagaacgaaacgaaaatgagcacagcaaaaaagattgtggcagcacaaaagtcaagaaaatgcacgtgtgatcatgactggccaatcatcaactgatacaacatccaagaaaaacgctccaatcacagcacctccacgaaacttgacggcaattgtcatgcaaccgattcttagccttgttacatgacgccatcatgtcacactgtgaactttgagttgatttgaacttacggatgggggacttttctccactctcatgtgatta

SEQ ID NO: 283955 - DNA, 622 bp, Homo sapiens
ttttttccctttgaagtgagattgaaaatagcctaactggaaaaagaccagacctaggaaagtgtcaattgaaaaaggcccccaaatttctagaaaaaaataaaatcacaatattttcaagtgcaagtaaatcaaccacgcatagatatttttaagatgttttccttatttttaagaaaaaaataatggtttgcacaggtaaatgatcccatgtttgataattcaggaattcatctttattttgactattttttgttcttttgttttgtttttttctctatgtgacatctagagaagcataaaaaaacgctgaacaagaaaaaccaaacaacagaaagtaaaaccactgcaagcaccaagaacgaaacgaaaatgagcacagcaaaaaagattgtggcagcacaaaagtcaagaaaatgcacgtgtgatcatgactggccaatcatcaactgatacaacatccaagaaaaacgctccaatcacagcacctccacgaaacttgacggcaattgtcatgcaaccgattcttagccttgttacatgacgccatcatgtcacactgtgaactttgagttgatttgaacttacggatgggggacttttctccactctcatgtgatta

SEQ ID NO: 283956 - DNA, 593 bp, Homo sapiens
ctgcacctggtgctgtccatggggctgcagctgtacggtttcaggcagcggcagcgagccagaaaggagtggaggctgcaccgcggcctgtctcaccgcagcgcctgctgggagggtcacacgttcagttggcacagagcacgttagaaccaggcctctcactggcatggggagtgcccggcagaaacgatcaagccagggggcaggttcagggagtctgaggtgcctgcttcgtagcctagcatgacggagaggcctgagctccagaccagccttggcatcaccagtgcagaaagagtcttagctatgaggctggcagagcaggtgaggatgtggggatgtccagggaccacctctcagaaaaggaggcggggagcggaaatgtggggctgcagacgctgcccaccagctaccctgctacagggaccgaagccccagtgtaacaaggcacgtggccccagggacactgctgccaccctcctgctggtgacacaggtagcttctgaccgtgccactgaaggacagctggctgccctcggcttcccgtgtcactttccactggctgggaaatggagacagccagacagcctcag

SEQ ID NO: 283957 - DNA, 396 bp, Homo sapiens
atgcagcccagtatcctgccctaagttccagaggaccattttccacatgaaaagtcttacggatagacaaacttccattcaagccaatgtcaagttttcattgcaagaaagtagcagccgtgtttaagagttcgctccaaatgctcatcttcttcttcggccctggatgtcagacaaacaggacaaacaggaaacaaaattatttttcttcgtggagggcagagcagcactcccccgtcgcccagtatttggatccccagcgggaatggggagcaccaggccagtgggaggctgccccggccctcccgcgacctctggattgaactttccgcacacttctcggcccctcggcaggtggcccagcctcgacccgaccccactgcccactcactgctt

SEQ ID NO: 283958 - DNA, 1908 bp, Homo sapiens
  misc_feature (1207)..(1207): n is a, c, g, or t
  misc_feature (1877)..(1877): n is a, c, g, or t
actcatcttgactctttcacatggtccaggcagtgaggggtggtgggggttatacagggcaatcttttgagtttctgatctcatcttttccttgggggaagtggaggtttagccacctcctatctactgagcagccttttttgggttgcagatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggtaagcagcgtgtgcccacaggcatgtccttcaccaacatctacagcaccctgagcggccagggccgcctctacgactacgggcagcggtttgttgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggntgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtcccgtcaagagcctggtgtactggggggagggagggaggagggagcctgtgctgacggagcacctcgcccgggtgttgcccctccctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcntcctagacaataaaggcagttgatagctctg

SEQ ID NO: 283959 - DNA, 3813 bp, Homo sapiens
  misc_feature (3112)..(3112): n is a, c, g, or t
  misc_feature (3782)..(3782): n is a, c, g, or t
cttctccgagtggggacattgctgacaatcccggcttcccgaggcggctaagaacaggcagtttgtgtcggctggctgcagatacccagaggcacaaagagaccgaagccacccggagggacccacggacggacagatggtaggcgcgaacccgagaggaccggcggaggctgagcaccgagagccgccaaggaagagaaactaaccacagccaagttaccccgccggctttccttcgctgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggtaagcagcgtgtgcccacaggcatgtccttcaccaacatctacagcaccctgagcggccagggccgcctctacgactacgggcagcggtttgttgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggntgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtcccgtcaagagcctggtgtactggggggagggagggaggagggagcctgtgctgacggagcacctcgcccgggtgttgcccctccctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcntcctagacaataaaggcagttgatagctctg

SEQ ID NO: 283960 - DNA, 884 bp, Homo sapiens
tttggggtgaggggagaaagtgctaggagctgggacccctcccccatccctcactctcatcagaagaggagaggagaagagaggttgggaccagtcttcaccccctggaatgtcgctgatgataaaaccataatggtggcagccccagcatttacaaagaggagggatgcggcacggccatcttgctgaaagcccgaactaaaggaagctgtgtttggacaacaggcacaatttggggtggtggcacagggccacacacctccggttaccccttggatcaaccacagcaggtgcacctgtccctgactcagagccctggaaccacactcaccagttctcaggactccttctccagccaactcagcatggggccttgtcttgctatctatattctctgcctaggtgatctcatccatactcgtggctttaaataccatctatatgccagtgactcacaaatgtatatttccagcccagacctctccttggagctccagactccgagatgtctgtttgtgatgtccaaatacatctccaaggcaatggatcacaaatggagtcctactccagacctgctctgctcccatcttttcgtctcagtggatggtcccatcattcctctagatggtctgctcaacacagaaacctaggaatcatcctgcttccttatctctcacctaatgaaccccaaattgagacctgttaggccaggttcgggggctcatgcctgtaatccgagaaatttgggaagccgaggtgggaggatcactggaggccaggagttcaaggttgaagtgagccatgatcgtgctgctacactccaagctgggtgacagagaatcccatctgtaaaagataagaataaaaagatctgttggttcaat

SEQ ID NO: 283961 - DNA, 893 bp, Homo sapiens
gggtggatataactaatgttattcttgagatgcatgaattaatgtttttgcaccacagacggaacatgattaattactagatgaaggcgttgattaattattactcactgattcactatggatgtcgaaggaaaaatcgaatgaataatattgtcctcccgccaggaggcatatgaaagaatcgttcccatgtgcgtggtggtggatgtgtggctccacgacactcggaaggtgtttcaccacccccctcctcagtggttagtgtcttctcctcctccggggtgggctgcccgcgagtgtcatcctgagtttgctccttcctgcttccagctcgcgaggtgttttgctactttcttcgtcacgtctgcttccagacgcgtgtcatgaatatagatgggctactttggtggcgcgccctcttgtcgtatctccgaatacgatggtcgttgttgtggcgtcggctgggtgctaccagggggagttgtgtctggtggctgctcctccgctcgctctctttttttttttttttttttttttttttttttctttttttttttttttttttttttttttttttttttttttttttttttttttttttaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283962 - DNA, 874 bp, Homo sapiens
  misc_feature (874)..(874): n is a, c, g, or t
agtagttggggaacacccggcgattctggcggctgcttcctggtggcgcagggagcccgcgtgtttgcgagtgcgtgtgtgtgcgaagttctccggctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggagggctcagagcatgtggtcgcgccttggggtctgggaccctgcttgcaagcctatcctttggtggctcagcagcggcctgaggagtgggtagcgcgcaggtagtgcccagggtagtgagatcgggcattgatgtgcactcgctctctgtcgcgctggcagtgtgatcgttctctatgagctgtgcctcgcttgaatcgtcatgacaatgtgtttcgaatccatcgaagggccaaagggagcactcatggcccctgagaatgctcaatgagcccgtcgcacgaacaccttgtatctgcttcaagtcgtggatcgcgtatgtcttgtccttgcgaaggcccttgttacagtgaccgggtatacaacgtaagagaagcgaatcgaactcaagaaggaaccatccctgtaggatctccagtgtgtagcatgggagacccttgagctttgggacgacggcggattctccacgaaaaccgatagctgtctcgaaccaaaggaggcgccaggatctcggccggcctgtgatan

SEQ ID NO: 283963 - DNA, 474 bp, Homo sapiens
tttggggtgaggggagaaagtgctaggagctgggacccctcccccatccctcactctcatcagaagaggagaggagaagagaggttgggaccagtcttcaccccctggaatgtcgctgatgataaaaccataatggtggcagccccagcatttacaaagaggagggatgcggcacggccatcttgctgaaagcccgaactaaaggaagctgtgtttggacaacaggcacaatttggggtggtggcacagggccacacacctccggttaccccttggatcaaccacaggtaacctatgcatgtggcacaaaattcaaaaaatacaaaaggatgtacgttgaaaacttgtcaagagacacagttaccattcttgtgcaggcctccagaaacaacatatgaacaactaagcaaacacggctaagctctttccctctcaaatggcagtattccaagcatgcttctctgcacttgcttt

SEQ ID NO: 283964 - DNA, 3060 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaaggtctcactctgttacccaggctggagtgcagtggagtgattatagcttactgcagccttgaccttctgggctcaagagatcctcccaccatcacgaggtcaggagatcgagaccatcttggctaagaagagactgtgtctcactgtgttgcccaggctggcttcactcaagcgatcctctcgccgcagtccctggagtagctgggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcagttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283965 - DNA, 3147 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaaggtctcactctgttacccaggctggagtgcagtggagtgattatagcttactgcagccttgaccttctgggctcaagagatcctcccaccatcacgaggtcaggagatcgagaccatcttggctaagaagagactgtgtctcactgtgttgcccaggctggcttcactcaagcgatcctctcgccgcagtccctggagtagctgggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcagttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccagctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283966 - DNA, 2622 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaagtagaggagcgcatgtgagccaagatccctaggcctgagccgtctaggtgtgtcccaggaactgcaggaaacggttggctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283967 - DNA, 2674 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaaggtctcactctgttacccaggctggagtgcagtggagtgattatagcttactgcagccttgaccttctgggctcaagagatcctcccaccatcacgaggtcaggagatcgagaccatcttggctaagaagctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283968 - DNA, 2034 bp, Homo sapiens
tgagtcagtggtgggcagcgagggtgataagccccttcgtgtcttcgggatgctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283969 - DNA, 2077 bp, Homo sapiens
ctcctccctcagatcgtgaggctccccagcctggctcgggagaccccgagatccccggccggtgacagcaggcgaccccctgctcctgtcaacctctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283970 - DNA, 210 bp, Homo sapiens
tggcctttggtacggtccggaatttttagggatcctcgactccgcgctctcctcgccggccgccgccgcccagcctgcgcccgccgtccccccagtgcctgggcacctgttggaggcagaggcaggtgcagggggctgggcaggccgggggcgtgagggtgcggggaagcgtgccagcctgtgtgcgctacgggggtgttcggctctcct

SEQ ID NO: 283971 - DNA, 2931 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaaggtctcactctgttacccaggctggagtgcagtggagtgattatagcttactgcagccttgaccttctgggctcaagagatcctcccaccatcacgaggtcaggagatcgagaccatcttggctaagaagagactgtgtctcactgtgttgcccaggctggcttcactcaagcgatcctctcgccgcagtccctggagtagctgggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcagttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaaaaaagagaaaaagaaaaaaaaccccgggggcttatatttgggggggggaaaaaaggggtttgacaatgggccttgtcccttgtttttcctgcccctttttgttcacgggggaaaacccggcgcccccaaagggggcgataaataaaagccgggaccggta

SEQ ID NO: 283972 - DNA, 3225 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaaggtctcactctgttacccaggctggagtgcagtggagtgattatagcttactgcagccttgaccttctgggctcaagagatcctcccaccatcacgaggtcaggagatcgagaccatcttggctaagaagagactgtgtctcactgtgttgcccaggctggcttcactcaagcgatcctctcgccgcagtccctggagtagctgggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcagttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccaggtagaggagcgcatgtgagccaagatccctaggcctgagccgtctaggtgtgtcccaggaactgcaggaaacggttggctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283973 - DNA, 2026 bp, Homo sapiens
tccccgcactttctcggcgctccctccctctcggctcgcacagcctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283974 - DNA, 3006 bp, Homo sapiens
ccctaggaaaggcgcagcggggcggactcccgggcctcctcccgcctcttccacaggttgcatccgcggctgcaggaaaacggatggctgggaatggccgtcgggggttggtcagaggaagtccctcggccctttccgaggcacatctcttggccatccacgcgtccttcgcagactccgctccctgcacctccgtttcctcttctgtggccggcggctcccccgtggccaccccatctcccatctctgccacctcccaacagccatttccactcctgcggccccatcccagctaaggagagcgcccttctgattggcaggtgggcctgtctgtcacgggcatgttccatcccacccaagcccaaggacactccagggtttccttagtttcacaacgaaggtgcgtgctcagcggactctgcagacccagtgccgcgacttcccctaaagccaggcgtgtatctgcgcgtgtgaggtgctctgccgcaaccctatgcagagagcaggtaacctatgcatgtggcacaaaattcaaaaaatacaaaaggatgtacgttgaaaaggtctcactctgttacccaggctggagtgcagtggagtgattatagcttactgcagccttgaccttctgggctcaagagatcctcccaccatcacgaggtcaggagatcgagaccatcttggctaagaagagactgtgtctcactgtgttgcccaggctggcttcactcaagcgatcctctcgccgcagtccctggagtagctgggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcagttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccagctcgactccgcgctctcctcgccggccgccgccgcccagcctgcgcccgccgtccccccagtgcctgggcacctgttggaggcagaggaagggaggccagtgagggccccacagaccgaggaggccgtcgcctggccctcagccaggatggctagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaagtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaactggac

SEQ ID NO: 283975 - DNA, 555 bp, Homo sapiens
ttttaagagacagggtcttgccatcttgctcaggctggtcttgaactcctggcctcgtgatcctcctacctcagcctccggaatagctgggattacaggcataagctacagtgccagctctttattcctttagatggtttggatacaggatataacgaagatccaagtaacagaacaatcaccatacctgattgatttcatcaactactctgaatggacatctatttagctcctgaagtgccatcaagtataacatggtagaaacacttctttcacctccactttgatgatgaggagttaattcatgcagttgagtactacttcgaaatttgactctaattcgaattccatatttatcataatcttcctataaaacatttaaaaagtgatgaaaaatgagtttcctctggtaatgtcattctattatttgaaaatggattgaattaactgagtaagagtaaagaactcaaaatttagtgacactagtttaaatatgtaacaataaatatatatgtatttttaaaaataataaatattaagcaaacagttactatc

SEQ ID NO: 283976 - DNA, 155 bp, Homo sapiens
ctgctgcgccatcttggcggggggaggggtgggggtgcagcacccacgtgtggagacgtgggtcgtccatctctccgggggtcgtttccaggagctgcagccctccagcctggggtctggccaggattaaccctgcttcctcccacccccgcagc

SEQ ID NO: 283977 - DNA, 520 bp, Homo sapiens
agatggcattggcaggaagtgctctcattccagccactcgttgcatatactggttggtcagtgatatctgtagatcaaccactgcacacacagacattataaagataacccatcctctggcatactgaatgacacaaaggacaaaaattattttggcttgtaatagccaagacttattgtctcttcttctccccatatggctttgatttgtccaggttcttgatgaagacgtttcccacaccagattttctcaaagagggatccctctgagaccacatgatgcggattggctttcccttaatcacatcaaagttcatggtgtccaaagcccgctcagctgtaagagagaaacacatttcaataaggagagaaaacgtcagctcccacaggccaacagcctaagaacagattactccaggacttttcaagtgaggtattgcatcaaagttatcaagtcatttagtctgcaatccacctatggagacaagtgacaaaacctgtaaagcaaatgatctggaaa

SEQ ID NO: 283978 - DNA, 531 bp, Homo sapiens
agaaaaaggcaggactatcctgtgaggaccagccccagggctcctggcttagaccagggctattcctaccacatcacactgccttcatgaagaaacctgatggccatgtttttaaaatgttcatttctgtgcaactatgtaaatgcatagaaaaggtctggaaggatacaaaccaaactgttaacagtggttaatcctagatatgagattgttggagtgaaggggcaccctttgctttttaaatttatttattttggtctgttatacttaaaagaaaatttatccatgcactgacatttttgtatttctttttagtgatatctgtagatcaaccactgcacacacagacattataaagataacccatcctctggcatactgaatgacacaaaggacaaaaattattttggcttgtaatagccaagacttattgtctcttcttctccccatatggctttggtaagttccccctctctgcattctacagtaacaaccacatcaaagcaacaaggtctgttatgaagtttttct
